US012456540B2

(12) United States Patent
Naughton et al.

(10) Patent No.: US 12,456,540 B2
(45) **Date of Patent: *Oct. 28, 2025**

(54) SYSTEMS AND METHODS FOR IDENTIFYING AND EXPRESSING GENE CLUSTERS

(71) Applicant: The Board of Trustees of the Leland Stanford Junior University, Stanford, CA (US)

(72) Inventors: Brian Thomas Naughton, Mountain View, CA (US); Colin Harvey, Mountain View, CA (US); Ulrich Schlecht, Falkensee (DE); Maureen Elizabeth Hillenmeyer, Palo Alto, CA (US); Joe Horecka, Fremont, CA (US)

(73) Assignee: The Board of Trustees of the Leland Stanford Junior University, Stanford, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/158,942

(22) Filed: Jan. 26, 2021

(65) Prior Publication Data

US 2021/0230611 A1 Jul. 29, 2021

Related U.S. Application Data

(63) Continuation of application No. 16/461,750, filed as application No. PCT/US2017/062100 on Nov. 16, 2017, now abandoned, which is a continuation-in-part of application No. 15/469,452, filed on Mar. 24, 2017, now Pat. No. 10,612,032.

(60) Provisional application No. 62/481,601, filed on Apr. 4, 2017, provisional application No. 62/423,196, filed on Nov. 16, 2016.

(51) Int. Cl.

| | |
|---|---|
| ***G16B 20/00*** | (2019.01) |
| ***C12N 15/79*** | (2006.01) |
| ***G16B 5/00*** | (2019.01) |
| ***G16B 10/00*** | (2019.01) |
| ***G16B 25/00*** | (2019.01) |
| ***G16B 30/00*** | (2019.01) |
| ***G16B 30/10*** | (2019.01) |

(52) U.S. Cl.
CPC ............ *G16B 20/00* (2019.02); *C12N 15/79* (2013.01); *G16B 5/00* (2019.02); *G16B 10/00* (2019.02); *G16B 25/00* (2019.02); *G16B 30/00* (2019.02); *G16B 30/10* (2019.02)

(58) Field of Classification Search
None
See application file for complete search history.

(56) References Cited

U.S. PATENT DOCUMENTS

| | | | |
|---|---|---|---|
| 4,876,197 | A | 10/1989 | Burke et al. |
| 5,672,491 | A | 9/1997 | Khosla et al. |
| 6,358,733 | B1 | 3/2002 | Motwani et al. |
| 7,172,886 | B2 | 2/2007 | Keasling et al. |
| 9,512,431 | B2 | 12/2016 | Temme et al. |
| 10,612,032 | B2 | 4/2020 | Harvey et al. |
| 10,808,256 | B2 | 10/2020 | Kelleher et al. |
| 2004/0171154 | A1 | 9/2004 | Storici et al. |
| 2007/0061084 | A1 | 3/2007 | Farnet et al. |
| 2007/0224208 | A1 | 9/2007 | Guo et al. |
| 2010/0272698 | A1 | 10/2010 | Stateva et al. |
| 2012/0045809 | A1 | 2/2012 | Buelter |
| 2013/0237435 | A1 | 9/2013 | Machida et al. |
| 2014/0273144 | A1 | 9/2014 | Hawkins |
| 2014/0342416 | A1 | 11/2014 | Jansen et al. |
| 2015/0275200 | A1 | 10/2015 | Jayaprakash et al. |
| 2015/0310168 | A1 | 10/2015 | Machida et al. |
| 2016/0213767 | A1 | 7/2016 | King et al. |
| 2017/0022532 | A1 | 1/2017 | Seyedsayamdost |
| 2017/0275635 | A1 | 9/2017 | Harvey et al. |
| 2018/0355020 | A1 | 12/2018 | Anchel |
| 2020/0040347 | A1 | 2/2020 | Naughton et al. |
| 2020/0291411 | A1 | 9/2020 | Harvey et al. |
| 2021/0032641 | A1 | 2/2021 | Kelleher et al. |
| 2023/0215512 | A1 | 7/2023 | Naughton et al. |
| 2024/0120023 | A1 | 4/2024 | Naughton et al. |

FOREIGN PATENT DOCUMENTS

| | | | |
|---|---|---|---|
| CN | 1242044 | A | 1/2000 |
| CN | 110268057 | A | 9/2019 |
| EP | 3541936 | A2 | 9/2019 |
| HK | 40011835 | A | 7/2020 |
| MX | 2019005701 | A | 10/2019 |

(Continued)

OTHER PUBLICATIONS

Blin, K.; Medema, M. H.; Kottmann, R.; Lee, S. Y.; Weber, T. The AntiSMASH Database, a Comprehensive Database of Microbial Secondary Metabolite Biosynthetic Gene Clusters. Nucleic Acids Research 2017, 45 (D1), D555-D559.*
Najmanova, L.; Ulanova, D.; Jelinkova, M.; Kamenik, Z.; Kettnerova, E.; Koberska, M.; Gazak, R.; Radojevic, B.; Janata, J. Sequence Analysis of Porothramycin Biosynthetic Gene Cluster. Folia Microbiologica 2014, 59 (6), 543-552.*

(Continued)

*Primary Examiner* — Olivia M. Wise
*Assistant Examiner* — Robert J. Kallal
(74) *Attorney, Agent, or Firm* — KPPB LLP

(57) ABSTRACT

Methods for identifying biosynthetic gene clusters that include genes for producing compounds that interact with specific target proteins are disclosed. Some methods relate to bioinformatics methods for identifying and/or prioritizing biosynthetic gene clusters. Related systems, components, and tools for the identification and expression of such gene clusters are also disclosed.

9 Claims, 90 Drawing Sheets

Specification includes a Sequence Listing.

(56) References Cited

FOREIGN PATENT DOCUMENTS

| | | | |
|---|---|---|---|
| WO | WO9213963 A1 | 8/1992 |
| WO | 2018094110 A2 | 5/2018 |
| WO | 2018094110 A3 | 8/2018 |
| WO | 2019055816 A1 | 3/2019 |

OTHER PUBLICATIONS

NCBI BLAST results for BRSK1, DDX41 and SOS1 gene similars in fungi and bacteria.*

Alanjary, M.; Kronmiller, B.; Adamek, M.; Blin, K.; Weber, T.; Huson, D.; Philmus, B.; Ziemert, N. The Antibiotic Resistant Target Seeker (ARTS), an Exploration Engine for Antibiotic Cluster Prioritization and Novel Drug Target Discovery. Nucleic Acids Research 2017, 45 (W1), W42-W48.*

Breinbauer, R.; Vetter, I. R.; Waldmann, H. From Protein Domains to Drug Candidates—Natural Products as Guiding Principles in the Design and Synthesis of Compound Libraries. Angewandte Chemie International Edition 2002, 41 (16), 2878-2890.*

Weber, T.; Kim, H. U. The Secondary Metabolite Bioinformatics Portal: Computational Tools to Facilitate Synthetic Biology of Secondary Metabolite Production. Synthetic and Systems Biotechnology 2016, 1 (2), 69-79.*

Extended European Search Report for European Application 17872034.8, Search Completed Apr. 8, 2020, Mailed Apr. 21, 2020, 8 Pgs.

International Preliminary Report on Patentability for International Application PCT/US2017/062100, Report issued May 21, 2019, Mailed May 31, 2019, 12 Pgs.

International Search Report and Written Opinion for International Application No. PCT/US2017/062100, Search completed Jun. 5, 2018, Mailed Jul. 2, 2018, 21 Pgs.

UniProtKB, pp. 1-3, downloaded Jan. 22, 2019.

"*Saccharomyces cerevisiae*", American Type Culture Collection (ATCC) Product Sheet, 208288, 2017, 2 pgs.

"*Saccharomyces cerevisiae*", American Type Culture Collection (ATCC) Product Sheet, 4001213, 2016, 2 pgs.

Baym et al., "Inexpensive Multiplexed Library Preparation for Megabase-Sized Genomes", PLoS ONE, vol. 10, No. 5, May 22, 2015, 15 pgs., doi:10.1037/journal.pone.0128036.

Belli et al., "An activator/repressor dual system allows tight tetracycline-regulated gene expression in budding yeast", Nucleic Acids Research, vol. 26, No. 4, 1998, pp. 942-947.

Blin et al., "antiSMASH 2.0—a versatile platform for genome mining of secondary metabolite producers", Nucleic Acids Research, vol. 41, Jun. 3, 2013, W204-W212, doi: 10.1093/nar/gk1449.

Botstein et al., "Yeast as a Model Organism", Science, vol. 277, No. 5330, Aug. 29, 1997, pp. 1259-1260.

Bowman, Brian R., "Rapid Engineering of Secondary Metabolite Gene Clusters in the Genomic Era. Presentation", SIMB. Warp Drive Bio. Aug. 2015. 26 pages.

Brachmann et al., "Designer deletion strains derived from *Saccharomyces cerevisiae* S288C: A useful set of strains and plasmids for PCR-mediated gene disruption and other applications", Yeast, vol. 14, Jan. 30, 1998, pp. 115-132.

Buijs et al., "Advanced biofuel production by the yeast *Saccharomyces cerevisiae*", Current Opinion in Chemical Biology, vol. 17, No. 3, Jun. 2013, Electronic Publication: Apr. 27, 2013, pp. 480-488.

Buren et al., "Formation of Nitrogenase NifDK Tetramers in the Mitochondria of *Saccharomyces cerevisiae*", ACS Synthetic Biology, Feb. 21, 2017, vol. 6, No. 6, pp. 1043-1055, DOI: 10.1021/acssynbio.6b00371.

Chooi et al., "A Cytochrome P450 Serves as an Unexpected Terpene Cyclase during Fungal Meroterpenoid Biosynthesis", Journal of the American Chemical Society, vol. 135, No. 45, Nov. 13, 2013, 12 pgs.

Christianson et al., "Multifunctional yeast high-copy-number shuttle vectors", Gene, vol. 110, No. 1, Jan. 2, 1992, pp. 119-122.

Da Silva et al., "Introduction and expression of genes for metabolic engineering applications in *Saccharomyces cerevisiae*", FEMS Yeast Research, vol. 12, No. 2, Mar. 1, 2012, pp. 197-214.

Daran-Lapujade et al., "Role of Transcriptional Regulation in Controlling Fluxes in Central Carbon Metabolism of *Saccharomyces cerevisiae*", The Journal of Biological Chemistry, vol. 279, No. 10, Mar. 15, 2004, pp. 9125-9138.

De Kok et al., "Rapid and Reliable DNA Assembly via Ligase Cycling Reaction", ACS Synthetic Biology, vol. 3, No. 2, Feb. 21, 2014, Electronic Publication: Jan. 15, 2014, pp. 97-106.

Deutschbauer et al., "Quantitative trait loci mapped to single-nucleotide resolution in yeast", Nature Genetics, Nov. 6, 2005, vol. 37, pp. 1333-1340, DOI: https://doi.org/10.1038/ng1674.

Dimitrov et al., "Polymorphisms in multiple genes contribute to the spontaneous mitochondrial genome instability of *Saccharomyces cerevisiae* S288C strains", Genetics 183, (2009): 365-383.

Gaisne et al., "A 'natural' mutation in Saccharomyces cerevisiae strains derived from S288c affects the complex regulatory gene HAP1 (CYP1)", Current Genetics, Oct. 1999, vol. 36, pp. 195-200.

Galanie et al., "Complete biosynthesis of opioids in yeast", Science, vol. 349, No. 6252, Sep. 4, 2015, pp. 1095-1100.

Gertz et al., "Composition-based statistics and translated nucleotide searches: Improving the TBLASTN module of BLAST", BMC Biology, Dec. 7, 2006, vol. 4, No. 41, 14 pgs., doi: 10.1186/1741-7007-4-41.

Gibson et al., "Chemical synthesis of the mouse mitochondrial genome", Nature Methods, vol. 7, No. 11, Nov. 2010, pp. 901-903.

Gibson et al., "Enzymatic assembly of DNA molecules up to several hundred kilobases", Nature Methods, vol. 6, No. 5, May 2009, pp. 343-345.

Gietz et al., "High-efficiency yeast transformation using the LiAc/SS carrier DNA/PEG method", Nature Protocols, vol. 2, No. 1, 2007, pp. 31-34.

Guo et al., "Recent advances in genome mining of secondary metabolites in Aspergillus terreus", Frontiers in Microbiology, Dec. 23, 2014, vol. 5, Article 717, 13 pgs., doi: 10.3389/fmicb.2014.00717.

Hinnen et al., "Transformation of yeast", Proceedings of the National Academy of Sciences of the United States of America, vol. 75, No. 4, Apr. 1978, pp. 1929-1933.

Horecka et al., "The 50:50 method for PCR-based seamless genome editing in yeast", Yeast, Mar. 2014, Published Online: Nov. 29, 2013, vol. 31, No. 3, pp. 103-112, DOI:10.1002/yea.2992.

Johnston et al., "Sequences That Regulate the Divergent GAL1-GAL10 Promoter in *Saccharomyces cerevisiae*", Molecular and Cellular Biology, vol. 4, No. 8, Aug. 1984, pp. 1440-1448.

Jones, "Tackling the protease problem in *Saccharomyces cerevisiae*", Methods in Enzymology, 1991, vol. 194, pp. 428-453, https://doi.org/10.1016/0076-6879(91)94034-A.

Keller et al., "Translating biosynthetic gene clusters into fungal armor and weaponry", Nature Chemical Biology, Aug. 18, 2015, vol. 11, pp. 671-677, DOI: https://doi.org/10.1038/nchembio.1897.

Kim et al., "Cloning large natural product gene clusters from the environment: Piecing environmental DNA gene clusters back together with TAR", Biopolymers, Sep. 2010, First Published: Jun. 23, 2010, vol. 93, No. 9, pp. 833-844, https://doi.org/10.1002/bip.21450.

Kim et al., "Screening of Yeast Diauxic Promoters for Production of Foreign Proteins", Journal of Microbiology and Biotechnology, vol. 16, No. 9, 2006, pp. 1459-1463.

Kuijpers et al., "A versatile, efficient strategy for assembly of multi-fragment expression vectors in *Saccharomyces cerevisiae* using 60 bp synthetic recombination sequences", Microbial Cell Factories, vol. 12, No. 47, May 10, 2013, 13 pgs.

Labbe et al., "Copper ion inducible and repressible promoter systems in yeast", Methods in Enzymology, 1999, vol. 306, pp. 145-153, https://doi.org/10.1016/S0076-6879(99)06010-3.

Lee et al., "A Highly Characterized Yeast Toolkit for Modular, Multipart Assembly", ACS Synthetic Biology, vol. 4, No. 9, Apr. 14, 2015, pp. 975-986.

Lee et al., "Determination of the extent of phosphopantetheinylation of polyketide synthases expressed in *Escherichia coli* and *Saccharomyces cerevisiae*", Analytical Biochemistry, Nov. 1, 2009, vol. 394, No. 1, pp. 75-80, https://doi.org/10.1016/j.ab.2009.07.010.

(56) References Cited

OTHER PUBLICATIONS

Lee et al., "Evaluation of the *Saccharomyces cerevisiae* ADH2 promoter for protein synthesis", Yeast, vol. 22, No. 6, Apr. 30, 2005, First Published: Apr. 22, 2005, pp. 431-440.
Liang et al., "Coordinated induction of multi-gene pathways in *Saccharomyces cerevisiae*", Nucleic Acids Research, vol. 41, No. 4, 2013, Published online: Dec. 22, 2012, 10 pgs.
Liu et al., "Rapid customised operon assembly by yeast recombinational cloning", Applied Microbiology and Biotechnology, Jun. 2017, vol. 101, No. 11, pp. 4569-4580, DOI: https://doi.org/10.1007/s00253-017-8213-9.
Mattoon et al., "Effects of hap mutations on heme and cytochrome formation in yeast", Current Genetics, Feb. 1990, vol. 17, No. 2, pp. 179-183, DOI: https://doi.org/10.1007/BF00312865.
Medema et al., "antiSMASH: rapid identification, annotation and analysis of secondary metabolite biosynthesis gene clusters in bacterial and fungal genome sequences", Nucleic Acids Research, Jul. 1, 2011, First Published: Jun. 14, 2011, vol. 39, No. suppl 2, pp. W339-W346, https://doi.org/10.1093/nar/gkr466.
Montiel et al., "Yeast homologous recombination-based promoter engineering for the activation of silent natural product biosynthetic gene clusters" Proc Natl Acad Sci U S A. Jul. 21, 2015; vol. 112 (29): 8953-8958.
Mumberg et al., "Yeast vectors for the controlled expression of heterologous proteins in different genetic backgrounds", Gene, vol. 156, No. 1, Apr. 14, 1995, pp. 119-122.
Negritto et al., "Influence of DNA Sequence Identity on Efficiency of Targeted Gene Replacement", Molecular and Cellular Biology, vol. 17, No. 1, Jan. 1997, pp. 278-286.
O'Brien et al., "Computational identification and analysis of orphan assembly-line polyketide synthases", The Journal of Antibiotics, 2014, vol. 67, pp. 89-97, published online Dec. 4, 2013, doi: 10.1038/ja.2013.125.
Ostergaard et al., "Physiological studies in aerobic batch cultivations of *Saccharomyces cerevisiae* strains harboring the MEL1 gene", Biotechnology and Bioengineering, May 5, 2000, First Published: Mar. 31, 2000, vol. 68, No. 3, pp. 252-259, https://doi.org/10.1002/(SICI)1097-0290(20000505)68:3<252::AID-BIT3>3.0.CO;2-K.
Peng et al., "Controlling heterologous gene expression in yeast cell factories on different carbon substrates and across the diauxic shift: a comparison on yeast promoter activities", Microbial Cell Factories, vol. 14, No. 91, Jun. 26, 2015, 11 pgs.
Pscheidt et al., "Yeast cell factories for fine chemical and API production", Microbial Cell Factories, vol. 7, No. 25, Aug. 7, 2008, 36 pgs.
Reeves et al., "Genes for the Biosynthesis of the Fungal Polyketides Hypothemycin from Hypomyces subiculosus and Radicicol from Pochonia chlamydosporia", Applied and Environmental Microbiology, vol. 74, No. 16, Aug. 2008, pp. 5121-5129.
Ro et al., "Production of the antimalarial drug precursor artemisinic acid in engineered yeast", Nature, vol. 440, No. 7086, Apr. 13, 2006, pp. 940-943.
Robinson, Keith, "Surveying Thousands of Actinomycete Genomes for Novel Biosynthetic Clusters", Presentation. Society of Industrial Microbiology and Biotechnology Annual Meeting, New Orleans. Warp Drive Bio., 2016, v.05.16, 20 pgs.
Ronicke et al., "Use of conditional promoters for expression of heterologous proteins in *Saccharomyces cerevisiae*", Methods in Enzymology, 1997, vol. 283, pp. 313-322, https://doi.org/10.1016/S0076-6879(97)83025-X.
Rutledge et al., "Discovery of microbial natural products by activation of silent biosynthetic gene clusters", Nature Reviews Microbiology, Aug. 2015, vol. 13, No. 8, pp. 509-523, DOI: https://doi.org/10.1038/nrmicro3496.
Scannell et al., "The Awesome Power of Yeast Evolutionary Genetics: New Genome Sequences and Strain Resources for the *Saccharomyces* sensu stricto Genus", G3: Genes, Genomes, Genetics, vol. 1, No. 1, Jun. 2011, pp. 11-25.
Shao et al., "DNA assembler, an in vivo genetic method for rapid construction of biochemical pathways", Nucleic Acids Research, vol. 37, No. 2, Feb. 2009, Published Online: Dec. 12, 2008, 10 pgs.
Smith et al., "A method for high-throughput production of sequence-verified DNA libraries and strain collections", Molecular Systems Biology, Feb. 1, 2017, vol. 13, No. 2, Article 913, 15 pgs., DOI 10.15252/msb.20167233.
Steen et al., "Metabolic engineering of *Saccharomyces cerevisiae* for the production of n-butanol", Microbial Cell Factories, vol. 7, No. 36, Dec. 3, 2008, 8 pgs.
Stinchcomb et al., "Isolation and characterisation of a yeast chromosomal replicator", Nature, vol. 282, Nov. 1, 1979, pp. 39-43.
Storici et al., "The Delitto Perfetto Approach to In Vivo Site-Directed Mutagenesis and Chromosome Rearrangements with Synthetic Oligonucleotides in Yeast", Methods in Enzymology, vol. 409, 2006, pp. 329-345, Doi: 10.1016/S0076-6879(05)09149-1.
Studier et al., "Protein production by auto-induction in high-density shaking cultures", Protein Expression and Purification, vol. 41, No. 1, May 2005, pp. 207-234.
Sun et al., "Cloning and Characterization of a Panel of Constitutive Promoters for Applications in Pathway Engineering in *Saccharomyces cerevisiae*", Biotechnology and Bioengineering, vol. 109, No. 8, Aug. 2012, Electronic Publication: Mar. 15, 2012, pp. 2082-2092.
Tang et al., "Discovery of Unclustered Fungal Indole Diterpene Biosynthetic Pathways through Combinatorial Pathway Reassembly in Engineered Yeast", Journal of the American Chemical Society, vol. 137, No. 43, Nov. 4, 2015, pp. 13724-13727.
Weber et al., "antiSMASH 3.0—a comprehensive resource for the genome mining of biosynthetic gene clusters", Nucleic Acids Research, Jul. 1, 2015, vol. 43, No. W1, pp. W237-W243.
Weinhandl et al., "Carbon source dependent promoters in yeasts", Microbial Cell Factories, vol. 13, No. 5, Jan. 9, 2014, 17 pgs.
Xu et al., "Bidirectional promoters generate pervasive transcription in yeast", Nature, vol. 457, No. 7232, Feb. 19, 2009, Published Online: Jan. 25, 2009, pp. 1033-1037.
Yu et al., "Adjacent Upstream Activation Sequence Elements Synergistically Regulate Transcription of ADH2 in *Saccharomyces cerevisiae*", Molecular and Cellular Biology, vol. 9, No. 1, Jan. 1989, pp. 34-42.
FBP1/YLR377C Sequence, downloaded Jul. 31, 2019, 7 pgs.
*S.cerevisiae* chromosome XI reading frame ORF YKR097w, downloaded Jul. 31, 2019, 2 pgs.
Botstein et al., "Yeast: an experimental organism for 21st century biology", Genetics, vol. 189, No. 3, Nov. 1, 2011, pp. 695-704.
Li et al., "Comprehensive curation and analysis of fungal biosynthetic gene clusters of published natural products", Fungal Genetics and Biology, vol. 89, Apr. 2016, pp. 18-28, doi: doi:10.1016/j.fgb.2016.01.012.
Basson et al., "Structural and Functional Conservation between Yeast and Human 3-Hydroxy-3-Methylglutaryl Coenzyme A Reductases, the Rate-Limiting Enzyme of Sterol Biosynthesis", Molecular and Cellular Biology, vol. 8, No. 9, Sep. 1988, pp. 3797-3808.
Botstein et al., "Yeast: An Experimental Organism for Modern Biology", Science, vol. 240, Jun. 10, 1988, pp. 1439-1443.
Li et al., "SLIC: A Method for Sequence- and Ligation-Independent Cloning", Chapter 5 In Gene Synthesis: Methods and Protocols, Methods in Molecular Biology, vol. 852, 2012, pp. 51-59.
Powers et al., "Genes in *S. cerevisiae* Encoding Proteins with Domains Homologous to the Mammalian ras Proteins", Cell, vol. 36, Mar. 1984, pp. 607-612.
Subazini et al., "Characterization of Lovastatin biosynthetic cluster proteins in Aspergillus terreus strain ATCC 20542", Bioinformation, vol. 6, No. 7, Jun. 23, 2011, pp. 250-254.
U.S. Appl. No. 17/158,942 Office Action dated Apr. 12, 2023.
U.S. Appl. No. 17/158,942 Office Action dated Feb. 8, 2023.
U.S. Appl. No. 17/158,942 Office Action dated Oct. 31, 2022.
"Cloning vector sequence (*E. coli*/yeast/phage P1) ADH2 gene, promoter; beta-lactamase gene; TRP1 gene; CYC1 gene, terminator; and two replication origins", GenBank Accession No. L11060.

(56) References Cited

OTHER PUBLICATIONS

Version No. L11060.1. Record created Jul. 26, 1993. 3 p. Retrieved May 17, 2023 at URL: https://www.ncbi.nlm.nih.gov/nuccore/L11060.
"ICL1 isocitrate lyase 1 [*Saccharomyces cerevisiae* S288C ]", Gene ID: 856794. Updated Apr. 14, 2023. 5 pages. Retrieved May 17, 2023 at URL: https://www.ncbi.nlm.nih.gov/gene/856794.
"*S. cerevisiae* promoter region of PCK1 gene", GenBank Accession No. X68938 S46233. Version No. X68938.1. Updated Aug. 11, 2005. 1 page. Retrieved May 17, 2023 at URL: https://www.ncbi.nlm.nih.gov/nuccore/X68938.
"*Saccharomyces bayanus* alcohol dehydrogenase isozyme 2 gene, partial cds", GenBank Accession No. AF218306. Version No. AF218306.1. Record created Mar. 16, 2000. 2 pages. Retrieved May 17, 2023 at URL: https://www.ncbi.nlm.nih.gov/nuccore/AF218306.
"*Saccharomyces cerevisiae* strain B1 malate synthase (MLS1) gene, partial cds", GenBank Accession No. AY942279. Version No. AY942279.1. Record created Jun. 28, 2005. 2 pages. Retrieved May 17, 2023 at URL: https://www.ncbi.nlm.nih.gov/nuccore/AY942279.
"*Saccharomyces cerevisiae* YJM1202 chromosome XIV sequence", GenBank Accession No. CP005533. Version No. CP005533.2. Updated May 23, 2016. 286 pages. Retrieved May 17, 2023 at URL: https://www.ncbi.nlm.nih.gov/nuccore/CP005533.
Gasmi et al., "The Switch from Fermentation to Respiration in *Saccharomyces cerevisiae* Is Regulated by the Ert1 Transcriptional Activator/Repressor", Genetics, Oct. 2014, vol. 198, 547-560.
Koonin et al., "Chapter 2 Evolutionary Concept in Genetics and Genomics", Sequence—Evolution—Function: Computational Approaches in Comparative Genomics. Boston: KluwerAcademic; 2003.
Medema et al., "Minimum Information about a Biosynthetic Gene cluster", Nature Chemical Biology, 2015, vol. 11, pp. 625-631.
Reeck et al., ""Homology" in Proteins and Nucleic Acids: A Terminology Muddle and a Way out of It", Cell, Aug. 28, 1987, vol. 50, 667.
Shen et al., "Development and characterization of a vector set with regulated promoters for systematic metabolic engineering in *Saccharomyces cerevisiae*", Yeast 2012; 29: 495-503.
Vickers et al., "Dual gene expression cassette vectors with antibiotic selection markers for engineering in *Saccharomyces cerevisiae*", 2013, pp. 1-10.
Young et al., "Evolution of a glucose-regulated ADH gene in the genus *Saccharomyces*", Gene, (2000), 245, 299-309.
Bills, Gerald F, et al. Biologically Active Secondary Metabolites from the Fungi. Microbiology Spectrum. vol. No. 4, Issue No. 6 (2016): 32 Pages.
Cacho, Ralph A, et al. Next-generation sequencing approach for connecting secondary metabolites to biosynthetic gene clusters in fungi. Frontiers in Microbiology. vol. No. 5, Issue No. 774 (2015): 16 Pages.
Foury, F. Human genetic diseases: a cross-talk between man and yeast. Gene. Aug. 11, 1997;195(1):1-10. doi: 10.1016/s0378-1119(97)00140-6.
Hutchinson et al. Aspects of the biosynthesis of non-aromatic fungal polyketides by iterative polyketide synthases. Antonie van Leeuwenhoek 78: 287-295, 2000.
Keller, Nancy P, et al. Fungal Secondary Metabolism—From Biochemistry To Genomics. Nature Reviews Microbiology. vol. No. 3, Issue No. 12 (2005): pp. 937-947.
Steinmetz, Lars M, et al. Systematic Screen For Human Disease Genes In Yeast. vol. No. 31, Issue No. 4 (2002): pp. 400-404.
U.S. Appl. No. 16/461,750 Office Action dated Jun. 2, 2023.
U.S. Appl. No. 16/461,750 Office Action dated May 8, 2024.
U.S. Appl. No. 16/461,750 Office Action dated Oct. 4, 2023.
U.S. Appl. No. 18/178,471 Office Action dated Feb. 29, 2024.
U.S. Appl. No. 18/178,471 Office Action dated Nov. 6, 2023.

* cited by examiner

Self-resistance mechanisms to toxic natural products

The hatched gene encodes mutated target protein, which is resistant to natural product Striped gene encodes a protein that performs enzymatic modification of toxic small molecule into a nontoxic form Dotted gene encodes a transporter protein that pumps the natural product out of the host cell KU42
Structure:

Example result: 5-gene pathway expressed in yeast results in polyketide production

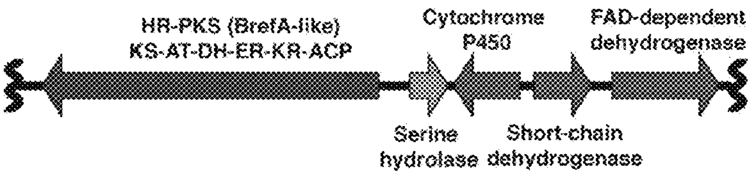

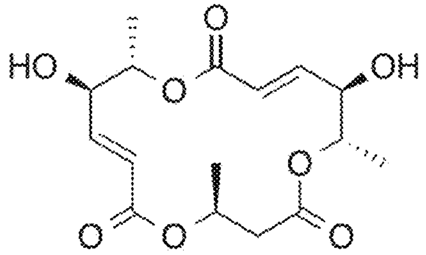

Ascomycota; Pezizomycotina; Dothideomycetes; Pleosporomycetidae; Pleosporales; Massarineae; Didymosphaeriaceae; Paraphaeosphaeria

*Microsphaeropis*
Ascomycota; Pezizomycotina; Dothideomycetes; Pleosporomycetidae; Pleosporales; Pleosporineae; Pleosporineae incertae sedis; Microsphaeropsis.

*FIG. 15B*

1 emindole SB 2

Strain 240 - PKS28 - *Moniliophthora roreri*

$^1$H NMR spectrum (500 MHz), $^{13}$C NMR spectrum (125 MHz), $CDCl_3$ compound 6

Key HMBC correlations

| position | $\delta_H$, mult ($J$ in Hz) | $\delta_C$ | COSY |
|---|---|---|---|
| 1 | | 173.92 | |
| 2 | 4.65, td (4.9, 8.5) | 50.65 | H3, H7 |
| 3 | 1.51, m, overlap<br>1.64, m, overlap | 41.98 | H2, H4 |
| 4 | 1.64, m, overlap | 25.04 | |
| 5[a] | 0.94, m, overlap | 22.98 | H4 |
| 6[a] | 0.94, m, overlap | 22.14 | H4 |
| 7-NH | 5.75, d (8.5) | | H2 |
| 8 | | 173.02 | |
| 9 | 2.21, m | 36.77 | H8 |
| 10 | 1.64, m, overlap | 25.73 | H9 |
| 11 | 1.28, m, overlap | 29.32 | |
| 12 | 1.28, m, overlap | 29.13 | |
| 13 | 1.28, m, overlap | 31.83 | |
| 14 | 1.30, m, overlap | 22.75 | |
| 15 | 0.88, t (7.2) | 14.82 | H14 |
| 16 | 3.73, s | 52.42 | |

Note: [a] Assignments denoted by superscript letters are interchangeable.

$^{1}H$ NMR spectrum (500 MHz), $^{13}C$ NMR spectrum (125 MHz), Acetone-$d_6$ compound 7

Key HMBC correlations

| position | $\delta_H$, mult (J in Hz) | $\delta_C$ | COSY |
|---|---|---|---|
| 1 | 1.87, d (6.2) | 18.85 | H2 |
| 2 | 6.26, m | 143.36 | H1, H3 |
| 3 | 7.35, m | 129.90 | H2, H4 |
| 4 | 6.45, t (11.2) | 142.84 | H3, H5 |
| 5 | 5.88, d (11.2) | 122.27 | H4 |
| 6 | | 188.99 | |
| 7 | 2.99, m | 25.86 | H8 |
| 8 | 2.08, m<br>2.19, m | 33.12 | H7, H11 |
| 9 | 4.59, m, overlap | 51.89 | H11 |
| 10 | | 172.86 | |
| 11-NH | 7.56, d (7.2) | | H9 |
| 12 | | 173.11 | |
| 13 | 4.59, m, overlap | 72.71 | H14 |
| 14 | 5.80, m | 127.68 | H13, H14 |
| 15 | 5.91, m | 137.57 | H14, H16 |
| 16 | 4.26, m | 67.72 | H15, H17 |
| 17 | 1.17, d (6.4) | 23.95 | H16 |

$^1$H NMR spectrum (500 MHz), $^{13}$C NMR spectrum (125 MHz), Acetone-$d_6$ compound 8

Key HMBC correlations

| position | $\delta_H$, mult (J in Hz) | $\delta_C$ | COSY |
|---|---|---|---|
| 1 | 1.86, dd (7.0, 1.7) | 18.84 | H2 |
| 2 | 6.28, m | 143.35 | H1, H3 |
| 3 | 7.36, m | 129.90 | H2, H4 |
| 4 | 6.45, t (11.2) | 142.63 | H3, H5 |
| 5 | 5.89, dd (11.2, 0.85) | 122.27 | H4 |
| 6 | | 188.97 | |
| 7 | 3.01, m | 25.89 | H8 |
| 8 | 2.09, m<br>2.19, m | 33.03 | H7, H11 |
| 9 | 4.60, m | 52.03 | H11 |
| 10 | | 172.89 | |
| 11-NH | 7.64, d (8.1) | | H9 |
| 12 | | 173.38 | |
| 13 | 4.06, d (3.6) | 74.89 | H14 |
| 14 | 4.34, m | 73.73 | H13, H14 |
| 15 | 5.61, m | 131.40 | H14, H16 |
| 16 | 5.75, m | 127.51 | H15, H17 |
| 17 | 1.66, dt (6.5, 1.4) | 17.95 | H16 |

$^{1}H$ NMR spectrum (500 MHz), $^{13}C$ NMR spectrum (125 MHz), $CDCl_3$ compound 9

Key HMBC correlations

| position | $\delta_H$, mult (J in Hz) | $\delta_C$ | COSY |
|---|---|---|---|
| 1 | | 165.07 | |
| 2 | 5.80, m | 125.02 | H3 |
| 3 | 6.84, m, overlap | 143.61 | H2, H4 |
| 4 | 2.31, m<br>2.40, m | 38.89 | H3, H5 |
| 5 | 5.05, m | 68.72 | H4, H14 |
| 6 | | 165.46 | |
| 7 | 5.77, m | 123.84 | H8 |
| 8 | 6.80, m, overlap | 144.69 | H7, H9 |
| 9 | 2.39, m | 39.50 | H8, H10 |
| 10 | 5.11, m | 70.21 | H8, H15 |
| 11 | | 170.30 | |
| 12 | 2.47, dd (15.3, 2.3)<br>2.57, dd (15.3, 10.8) | 41.63 | H13 |
| 13 | 5.35, m | 67.81 | H12, H16 |
| 14 | 1.34, d (6.3) | 21.16 | H5 |
| 15 | 1.27, d (6.3) | 20.68 | H10 |
| 16 | 1.30, d (6.3) | 20.21 | H13 |

$^1$H NMR spectrum (500 MHz), $^{13}$C NMR spectrum (125 MHz), $CDCl_3$ compound 10

Key HMBC correlations

| position | $\delta_H$, mult ($J$ in Hz) | $\delta_C$ | COSY |
|---|---|---|---|
| 1 | 1.22, d (6.3) | 22.56 | H2 |
| 2 | 4.19, m, overlap | 64.41 | H1, H3 |
| 3 | 2.45, m, overlap | 43.70 | H2 |
| 4 | | 172.48 | |
| 5 | 1.28, m, overlap | 19.81 | H6 |
| 6 | 5.07, m | 69.71 | H5, H7 |
| 7 | 2.45, m, overlap | 38.48 | H6, H8 |
| 8 | 6.86, dt (15.5, 7.4) | 143.31 | H7, H9 |
| 9 | 5.87, dt (15.5, 1.4) | 124.51 | H8 |
| 10 | | 166.27 | |
| 11 | 4.19, m, overlap | 60.55 | H12 |
| 12 | 1.28, m, overlap | 14.38 | H11 |

$^{1}H$ NMR spectrum (500 MHz), $^{13}C$ NMR spectrum (125 MHz), $CDCl_3$ compound 11

| position | $\delta_H$, mult (J in Hz) | $\delta_C$ |
|---|---|---|
| 1 | | 53.82 |
| 2 | 3.63, brs | 82.58 |
| 3 | | 42.57 |
| 4 | 1.88, m | 45.26 |
| 5 | 1.46, m<br>1.74, m | 25.83 |
| 6 | 1.20, m<br>1.88, m | 22.18 |
| 7 | 1.09, d (10.1)<br>1.45, m | 36.58 |
| 8 | 1.31, m | 42.81 |
| 9 | 1.96, m | 22.95 |
| 10 | 5.09, m | 124.95 |
| 11 | | 131.47 |
| 12 | 3.75, d (10.5)<br>3.84, d (10.5) | 68.54 |
| 13 | 0.87, s | 16.47 |
| 14 | 1.61, s | 17.79 |
| 15 | 1.68, s | 25.65 |

$^1$H NMR spectrum (500 MHz), $^{13}$C NMR spectrum (125 MHz), $CDCl_3$ compound 12

Key HMBC correlations

| position | $\delta_H$, mult (J in Hz) | $\delta_C$ | COSY |
|---|---|---|---|
| 1 | 1.43, m | 40.63 | H2, H6, H12 |
| 2[a] | 0.95, m, overlap<br>1.87, m, overlap | 28.71 | H1, H3 |
| 3[b] | 1.08, m, overlap<br>1.81, m | 26.95 | H2, H4 |
| 4 | 1.32, m | 47.52 | H3, H5 |
| 5[b] | 1.12, m, overlap<br>1.89, m, overlap | 28.22 | H4, H6 |
| 6[a] | 0.95, m, overlap<br>1.87, m, overlap | 29.76 | H1, H5 |
| 7 | | 74.61 | |
| 8 | 1.49, dd (9.9, 6.8) | 39.90 | H9 |
| 9 | 2.05, m | 22.27 | H8, H10 |
| 10 | 5.13, t (7.3) | 124.70 | H9 |
| 11 | | 131.92 | |
| 12 | 3.46, d (6.3) | 68.78 | |
| 13 | 1.11, s | 24.03 | |
| 14 | 1.62, s | 17.83 | |
| 15 | 1.69, s | 25.88 | |

Note: [a, b] Assignments denoted by superscript letters are interchangeable.

$^1$H NMR spectrum (500 MHz), $^{13}$C NMR spectrum (125 MHz), $CDCl_3$ compound 13

Key HMBC correlations

| position | $\delta_H$, mult ($J$ in Hz) | $\delta_C$ | COSY |
|---|---|---|---|
| 1 | | 137.73 | |
| 2 | 5.68, m | 122.58 | H3 |
| 3 | 2.13, m, overlap<br>2.15, m | 26.75 | H2, H4 |
| 4 | 1.60, m, overlap | 43.28 | H3, H5 |
| 5 | 1.29, m<br>1.89, m, overlap | 23.41 | H4, H6 |
| 6 | 1.86, m<br>2.05, m, overlap | 26.75 | H5 |
| 7 | | 74.44 | |
| 7-OH$^a$ | 1.25, brs | | |
| 8 | 1.51, m | 40.21 | H9 |
| 9 | 2.06, m, overlap | 22.23 | H8, H10 |
| 10 | 5.13, t (7.3) | 124.59 | H9 |
| 11 | | 132.03 | |
| 12 | 4.02, m | 67.31 | |
| 12-OH$^a$ | 1.15, brs | | |
| 13 | 1.12, s | 23.41 | |
| 14 | 1.62, s | 17.85 | |
| 15 | 1.69, s | 25.88 | |

Note: $^a$ Assignments denoted by superscript letters are interchangeable.

$^1H$ NMR spectrum (500 MHz), $^{13}C$ NMR spectrum (125 MHz), $CDCl_3$ compound 14

Key HMBC correlations

| position | $\delta_H$, mult (J in Hz) | $\delta_C$ | COSY |
|---|---|---|---|
| 1 | 5.59 | 125.69 | H6 |
| 2 | | 134.41 | |
| 3 | 4.02, brs | 68.81 | H4 |
| 4 | 1.59, m, overlap<br>1.95, m | 37.34 | H3, H5 |
| 5 | 2.33, m | 34.14 | H4, H6 |
| 6 | 1.83, m<br>2.16, m, overlap | 31.74 | H1, H5 |
| 7 | | 153.42 | |
| 8 | 2.08, m | 35.04 | H9 |
| 9 | 2.13, m, overlap | 26.90 | H8, H10 |
| 10 | 5.12 | 124.30 | H9 |
| 11 | | 131.79 | |
| 12 | 4.78, s | 107.88 | |
| 13 | 1.61, s | 17.90 | |
| 14 | 1.68, s | 25.85 | |
| 15 | 1.80, s | 20.99 | |

$^1$H NMR spectrum (500 MHz), $^{13}$C NMR spectrum (125 MHz), $CDCl_3$ compound 15

Key HMBC correlations

| position | $\delta_H$, mult (J in Hz) | $\delta_C$ | COSY |
|---|---|---|---|
| 1 | | 214.32 | |
| 2 | | 77.27 | |
| 2-OH | 2.14, brs | | |
| 3 | 2.21, m, overlap | 48.00 | H7 |
| 4 | | 42.58 | |
| 5 | 2.18, m, overlap | 38.94 | H6, H7 |
| 6 | 2.62, m | 43.12 | H5 |
| 7 | 1.68, m, overlap<br>2.43, m | 28.77 | H3, H5 |
| 8 | 1.66, m, overlap<br>1.80, m | 39.12 | H9 |
| 9 | 2.00, m | 23.78 | H8, H10 |
| 10 | 5.18, m | 124.51 | H9 |
| 11 | | 131.82 | |
| 12 | 1.39, s | 25.51 | |
| 13 | 0.88, s | 19.90 | |
| 14 | 1.63, s | 17.77 | |
| 15 | 1.70, s | 25.87 | |

$^1H$ NMR spectrum (500 MHz), $^{13}C$ NMR spectrum (125 MHz), $CDCl_3$ compound 18

Key HMBC correlations

| position | $\delta_H$, mult (J in Hz) | $\delta_C$ | COSY |
|---|---|---|---|
| 1 | 5.56, m | 125.41 | H6 |
| 2 | | 134.61 | |
| 3 | 4.04, m | 68.78 | |
| 4 | 1.42, td (13.2, 3.8, 1)<br>2.03, m, overlap | 32.18 | H5 |
| 5 | 1.78, m, overlap | 38.90 | H4, H6 |
| 6 | 1.74, m, overlap<br>2.04, m, overlap | 27.32 | H1, H5 |
| 7 | | 73.38 | |
| 8 | 1.50, m | 40.41 | H9 |
| 9 | 2.06, m, overlap | 22.20 | H8, H10 |
| 10 | 5.12, m | 124.57 | H9 |
| 11 | | 131.98 | |
| 12 | 1.11, s | 23.39 | |
| 13 | 1.61, s | 17.84 | |
| 14 | 1.68, s | 25.86 | |
| 15 | 1.78, s | 21.00 | |

SYSTEMS AND METHODS FOR IDENTIFYING AND EXPRESSING GENE CLUSTERS

CROSS-REFERENCE

This application is a continuation of U.S. patent application Ser. No. 16/461,750, filed May 16, 2019, which is a national stage of PCT Patent Application No. PCT/US2017/062100, filed Nov. 16, 2017, which claims the benefit of U.S. Provisional Application No. 62/423,196, filed Nov. 16, 2016, U.S. Provisional Application No. 62/481,601, filed Apr. 4 2017, and U.S. Ser. No. 15/469,452, filed Mar. 24, 2017, which applications are incorporated herein by reference.

STATEMENT AS TO FEDERALLY SPONSORED RESEARCH

This invention was made with Government support under contract GM110706 awarded by the National Institutes of Health. The Government has certain rights in the invention.

REFERENCE TO A SEQUENCE LISTING SUBMITTED ELECTRONICALLY VIA EFS-WEB

The instant application contains a Sequence Listing which has been filed electronically in ASCII format and is hereby incorporated by reference in its entirety. Said ASCII copy, created on Nov. 9, 2017, is named 52592-702_601_SL.txt and is 1,208,543 bytes in size.

TECHNICAL FIELD

The present disclosure generally relates to the introduction of gene clusters into host organisms for the manufacture of small molecules. In some cases, the small molecules are analogs to products produced by the organism in which the gene cluster is identified and that modulate a specific protein. More specifically, the disclosure also relates to the identification of gene clusters likely to produce products that target a specific target protein and methods of expressing gene clusters in host cells. Additionally sequences of various gene clusters are provided, together with structures of compounds produced from these gene clusters.

BACKGROUND

"Secondary metabolites," as used herein, are small molecules that can be produced by the expression of one or more gene clusters. Often, secondary metabolites are not critical for the survival of the organism in which the gene cluster is natively found. Secondary metabolites can be clinically valuable small molecules. Examples include: antibacterial products such as penicillin, and daptomycin; antifungal products such as amphotericin; cholesterol-lowering products such as lovastatin; anticancer products such as taxol, and eribulin; and immune-modulating products including rapamycin, and cyclosporine. In spite of the great success of secondary metabolites in the history of drug discovery, challenges of secondary metabolites in drug discovery and development can include (i) extremely low yields, (ii) limited supply, (iii) complex structures posing difficulty for structural modifications, and (iv) complex structures precluding practical synthesis. These difficulties have prompted the pharmaceutical industry to embrace new technologies in past decades, particularly combinatorial chemistry, as an alternative to natural product discovery. As a result, the percentage of new secondary metabolites being tested for use in medical treatment of humans has declined steadily since the 1940s due to a greater reliance on synthetic libraries that can be utilized in high throughput screening. Despite the pharmaceutical industry's preference for synthetic libraries, secondary metabolites possess enormous structural and chemical diversity that is unsurpassed by synthetic libraries. Most importantly, secondary metabolites are often evolutionarily optimized as drug-like molecules to target specific proteins and/or pathways.

Now, thousands of bacterial and fungal genomes have been sequenced. These organisms are known to be rich sources of secondary metabolites. These secondary metabolites are enzymatically biosynthesized by the products of one or more genes, often grouped into gene clusters. New genome sequences have revealed that traditional approaches have tapped only a fraction of the biosynthetic potential of these organisms as, on average, fewer than 10% of the biosynthetic gene clusters (BGCs) in a microbial genome are expressed in any single culture condition. Further, millions of fungal species are believed to exist in nature, but have not been cultured in the laboratory. Accordingly, the supply bottleneck for secondary metabolites can be reduced by introducing the genes utilized in the synthesis of the secondary metabolite into a microorganism that can overproduce a desired secondary metabolite or analog thereof. In this way, the vast, untapped, ecological biodiversity of microbes holds renewed promise for the discovery of novel secondary metabolites useful in one or more contexts, such as the treatment of disease.

SUMMARY OF THE INVENTION

In some embodiments, this disclosure refers to a method for screening a plurality of compounds, the method comprising: identifying a gene cluster that includes or is within 20 kilobases of a region that encodes for a protein that is identical with or homologous to a first target protein, wherein the gene cluster comprises a region that encodes for a protein selected from the group consisting of (1) polyketide synthases and (2) non-ribosomal peptide synthetases, (3) terpene synthetases, (4) UbiA-type terpene cyclases, and (5) dimethylallyl transferases; introducing a plurality of genes from the gene cluster into a vector; introducing the vector into a host cell; expressing the proteins encoded by the plurality of genes in the host cell; and determining whether a compound that is formed or modified by the expressed proteins modulates the first target protein. In some cases, the host cell is a yeast cell. In some cases, the yeast cell is a yeast cell that has been modified to increased sporulation frequency and increased mitochondrial stability. In some cases, each gene of the plurality of genes is under the control of a different promoter. In some cases, the promoters are designed to increase expression when the host cell is in the presence a nonfermentable carbon source. In some cases, the plurality of genes are introduced into the vector via homologous recombination. In some cases, introducing the plurality of genes into the vector via homologous recombination comprises combining a first plurality of nucleotides with a second plurality of nucleotides, wherein: each polynucleotide of the first plurality of DNA polynucleotides encodes for a promoter and terminator, wherein each promoter and terminator is distinct from the promoter and terminator of other polynucleotides of the first plurality of nucleotides; and each polynucleotide of the second plurality of nucleotides includes a coding sequence, a first flanking region on the 5' side of the polynucleotide and a second flanking region on the 3' side of the polynucleotide; and introducing the polynucleotides into a host cell that includes machinery for homologous recombination, wherein the host cell assembles the expression vector via homologous recombination that occurs in the flanking regions of the second plurality of polynucleotides; wherein the expression vector is configured to facilitate simultaneous production of a plurality of proteins encoded by the second plurality of nucleotides. In some cases, the first flanking region and the second flanking region are each between 15 and 75 base pairs in length. In some cases, the first flanking region and the second flanking region are each between 40 and 60 base pairs in length. In some embodiments, the present disclosure provides a method for identifying a gene cluster capable of producing a small molecule for modulating a first target protein, the method comprising: selecting, from a database comprising a list of biosynthetic gene clusters, one or more gene clusters that include or are positioned proximal to a region that encodes a protein that is identical with or homologous to the first target protein. In some cases, the one or more gene clusters are selected from the group consisting of (1) clusters that comprise one or more polyketide synthases and (2) clusters that comprise one or more non-ribosomal peptide synthetases, (3) clusters that comprise one or more terpene synthases, (4) clusters that comprises one or more UbiA-type terpene cyclases, and (5) clusters that comprise one or more dimethylallyl transferases. In some cases, the protein that is encoded by the region that is included in or positioned proximal to the biosynthetic gene cluster is identical to or has greater than 30% homology to the first target protein. In some cases, the region that encodes the protein that is identical with or homologous to the first target protein is within 20,000 base pairs of a region of a portion of the gene cluster that encodes a polyketide synthase, a non-ribosomal peptide synthetase, a terpene synthetase, a UbiA-type terpene cyclase, or a dimethylallyl transferase. In some cases, the first target protein is BRSK1. In some cases, selecting the one or more gene clusters comprises operating a computer, wherein operation of the computer comprises running an algorithm that takes into account both an input sequence for the first target protein and sequence information from a database that includes sequence information from a plurality of species such that the computer returns information corresponding to one or more gene clusters. In some cases, the algorithm takes into account the phylogenetic relationship between gene clusters in the database. In some cases, the one or more gene clusters include a coding sequence for a protein that is an extracellular protein, a membrane-tethered protein, a protein involved in a transport or secretion pathway, a protein homologous to a protein involved in a transport or secretion pathway, a protein with a peptide targeting signal, a protein with a terminal sequence with homology to a targeting signal, an enzyme that degrades small molecules, or a protein with homology to an enzyme that degrades small molecules. In some embodiments the present disclosure provides a method for producing a compound that modulates the first target protein, the method comprising: identifying a gene cluster (e.g., via methods disclosed herein), expressing the gene cluster or a plurality of genes from the gene cluster in a host cell, and isolating a compound produced by the gene cluster. In some cases, the method further comprises screening the isolated compound for modulation of an activity of the first target protein. In some cases, the cluster-encoded protein that is homologous to the first target protein is resistant to modulation by the isolated compound when compared to modulation of the first target protein. In some cases, the compound is not toxic to the species from which the cluster originates due to one or more of (1) sequence differences between target protein and the cluster-encoded protein, (2) spatial separation of the compound from the cluster-encoded protein and (3) high expression levels for the cluster-encoded protein.

In some embodiments the present disclosure provides a method for making a DNA vector, the method comprising: identifying a gene cluster comprising a plurality of genes that are capable of producing a small molecule for modulating a first target protein; introducing two or more genes of the plurality of genes into a vector, wherein the vector is configured to facilitate expression of the two or more genes in a host organism; wherein (1) the gene cluster encodes one or more proteins selected from the group consisting of a polyketide synthase, a non-ribosomal peptide synthetase, a terpene synthetase, a UbiA-type terpene cyclase, and a dimethylallyl transferase and (2) the gene cluster includes or is positioned proximal to a region that encodes a protein that is identical with or homologous to the first target protein. In some cases, the DNA vector is a circular plasmid. In some cases, the DNA vector comprises a plurality of promoters, wherein each promoter of the plurality of promoters is configured to, when the vector is introduced into a *Saccharomyces cerevisiae* cell, promote a lower level of heterologous expression when the cell exhibits predominantly anaerobic energy metabolism than when the cell exhibits aerobic energy metabolism. In some cases, each promoter of the plurality of promoters differs in sequence from one another. In some cases, each promoter of the plurality of promoters has a sequence selected from the group consisting of: SEQ ID NOs: 1-66. In some cases, each promoter of the plurality of promoters has a sequence selected from the group consisting of: SEQ ID NOs: 20-35, and SEQ ID NOs: 41-50. In some cases, when the *Saccharomyces cerevisiae* cell is exhibiting anaerobic energy metabolism, the cell is catabolizing a fermentable carbon source selected from glucose or dextrose; and when the *Saccharomyces cerevisiae* cell is exhibiting aerobic energy metabolism, the cell is catabolizing a non-fermentable carbon source selected from ethanol or glycerol.

In some embodiments the present disclosure provides a method for the heterologous expression of a plurality of genes in a yeast strain, the method comprising: obtaining a yeast strain that includes a vector for expressing a plurality of genes from a single gene cluster of a non-yeast organism; and inducing expression of the plurality of genes; wherein the gene cluster in the non-yeast organism includes or is positioned proximal to a region that encodes a protein that is at least 30% homologous to a target protein. In some cases, the method further comprises introducing the plurality of genes from the single gene cluster into the vector. In some cases, the method further comprises introducing the vector into the yeast strain. In some cases, expression of the plurality of genes results in the formation of small molecule, wherein the small molecule modulates the activity of the target protein. In some cases, the gene cluster is a gene cluster of a non-yeast fungus. In some cases, the yeast strain is from *Saccharomyces cerevisiae*. In some cases, the target protein is a human protein.

In some embodiments the present disclosure provides a system for identifying a gene cluster for introduction of a plurality of genes from the gene cluster into a host organism, the system comprising: a processor; a non-transitory computer-readable medium comprising instructions that, when executed by the processor, cause the processor to perform operations, the operations comprising: loading the identity or sequence of a first target protein into memory; loading the identity or sequence of a plurality of biosynthetic gene clusters into memory; identifying, from the plurality of biosynthetic gene clusters, one or more gene clusters that encode or are positioned proximal to a region that encodes a protein that is identical with or homologous to the first target protein; and scoring the one or more gene clusters based on the likelihood of each gene cluster being capable of use to produce a small molecule that modulates the first target protein. In some cases, scoring the one or more gene clusters comprises comparing the sequence of the first target protein (or a DNA sequence encoding the first target protein) to a sequence of a protein encoded in or proximal to the gene cluster (or to a DNA sequence encoding the protein that is in or proximal to the gene cluster).

In some embodiments the present disclosure provides a system for identifying one or more biosynthetic gene clusters for introduction into a host organism to produce one or more compounds that modulate a specific target protein, the system comprising: a processor; a memory containing a gene cluster identification application; wherein the gene cluster identification application directs the processor to: load data describing at least one target protein into the memory; load data describing a plurality of biosynthetic gene clusters into the memory; score each of the plurality of biosynthetic gene clusters based upon: performing a homolog search for each biosynthetic gene cluster to determine a presence of at least one homolog of a target protein within or adjacent the biosynthetic gene cluster; confidence of homology of the at least one target protein to at least one gene in a biosynthetic gene cluster; a fraction of a homologous gene that meets an identity threshold; a total number of genes homologous to the at least one target protein present in the entire genome of an organism; homology of the at least one homolog of at least one target protein within or adjacent the biosynthetic gene cluster to genes in the target protein's genome; phylogenetic relationship of the at least one target protein to a gene in a cluster; expected number of homologs of the at least one target protein in or adjacent to a biosynthetic cluster; and a likelihood that at least one target protein is essential for cellular process in the natural environment; and output a report identifying one or more biosynthetic gene clusters that are most likely to produce a compound that modulates the at least one target protein.

In some embodiments the present disclosure provides a method for selecting a biosynthetic gene cluster that produces a secondary metabolite, the method comprising: obtaining a list of gene clusters; performing a phylogenetic analysis of the genes within the clusters compared to known genes from known biosynthetic gene clusters; and selecting the biosynthetic gene cluster based on its phylogenetic relationship with the known genes. In some cases, the biosynthetic gene cluster with the most distant phylogenetic relationship from the known genes is selected.

In some embodiments the present disclosure provides a method for identifying a gene cluster that produces a compound that binds a protein of interest, the method comprising: obtaining sequence information for a plurality of contiguous sequences, wherein each contiguous sequence includes a biosynthetic gene cluster and flanking genomic sequences; analyzing the contiguous sequences for the presence of a gene that encodes a protein with homology to the protein of interest, and selecting a biosynthetic gene cluster which includes, or is proximal to, a gene that encodes a protein that is homologous to the protein of interest. In some cases, the contiguous nucleotide sequence is less than 40,000 base pairs in length.

In some embodiments, the present disclosure provides a modified yeast cell having a BY background, wherein relative to unmodified BY4741 and BY4742, the modified yeast cell has both (1) increased sporulation frequency and (2) increased mitochondrial stability. In some cases, the modified yeast cell grows faster on non-fermentable carbon sources than unmodified BY4741 and BY4742. In some cases, the yeast cell comprises one or more of the following genotypes: MKT1(30G), RME1(INS-308A), and TAO3 (1493Q). In some cases, the yeast cell comprises one or more of the following genotypes: CAT5(91M), MIP1 (661T), SAL1+, and HAP1+. In some embodiments the present disclosure provides a method of forming an expression vector, the method comprising: combining a first plurality of DNA polynucleotides with a second plurality of polynucleotides, wherein: each polynucleotide of the first plurality of DNA polynucleotides encodes for a promoter and terminator, wherein each promoter and terminator is distinct from the promoter and terminator of other polynucleotides of the first plurality of nucleotides; and each polynucleotide of the second plurality of nucleotides includes a coding sequence, a first flanking region on the 5' side of the polynucleotide and a second flanking region on the 3' side of the polynucleotide, wherein each flanking region is between 15 and 75 base pairs in length; and introducing the polynucleotides into a host cell that includes machinery for homologous recombination, wherein the host cell assembles the expression vector via homologous recombination that occurs in the flanking regions of the second plurality of polynucleotides; wherein the expression vector is configured to facilitate simultaneously production of a plurality of proteins encoded by the second plurality of nucleotides. In some cases, the host cell is a yeast cell. In some cases, each flanking region is between 40 and 60 base pairs in length. In some cases, at least one polynucleotide of the first plurality of nucleotides encodes a selection marker.

In some embodiments, the present disclosure provides a system for generating a synthetic gene cluster via homologous recombination, the system comprising 1 though N unique promoter sequences, 1 through N unique terminator sequences, and 1 through N unique coding sequences, wherein: coding sequence 1 is attached to an additional 30-70 base pair sequence on each end such that a first end portion is identical to the last 30-70 base pairs of promoter 1 and a second end portion is identical to the first 30-70 base pairs of terminator 1; coding sequence 2 is attached to an additional 30-70 base pair sequence on each end such that a first end portion is identical to the last 30-70 base pairs of promoter 2 and a second end portion is identical to the first 30-70 base pairs of terminator 2; and coding sequence N is attached to an additional 30-70 base pair sequence on each end such that a first end portion is identical to the last 30-70 base pairs of promoter N and a second end portion is identical to the first 30-70 base pairs of terminator N. In some cases, terminator 1 and promoter 2 are portions of the same double-stranded oligonucleotide.

In some embodiments, the present disclosure provides a method for assembling a synthetic gene cluster, the method comprising: obtaining 1 through N unique promoters, 1 through N unique terminators, and 1 through N unique coding sequences, wherein: coding sequence 1 is attached to an additional 30-70 base pair sequence on each end such that a first end portion is identical to the last 30-70 base pairs of promoter 1 and a second end portion is identical to the first 30-70 base pairs of terminator 1; coding sequence 2 is attached to an additional 30-70 base pair sequence on each end such that a first end portion is identical to the last 30-70 base pairs of promoter 2 and a second end portion is identical to the first 30-70 base pairs of terminator 2; and coding sequence N is attached to an additional 30-70 base pair sequence on each end such that a first end portion is identical to the last 30-70 base pairs of promoter N and a second end portion is identical to the first 30-70 base pairs of terminator N; transforming the 1 through N promoters, terminators and coding sequences into a yeast cell; isolating a plasmid containing the 1 through N promoters, terminators and coding sequences from the yeast cell. In some cases, the method further comprises a coding sequence for a selection marker. In some cases, the selection marker is an auxotrophic marker. In some cases, the yeast cell has a deficiency in a DNA ligase gene.

In some embodiments the present disclosure provides a yeast strain which allows for both (1) homologous DNA assembly and (2) production of heterologous genes in the same strain. In some cases, the yeast strain is a DHY strain. In some cases, the strain allows DNA assembly via homologous recombination with an efficiency of at least 80% as compared to DNA assembly in BY. In some cases, production of heterologous compounds in the strain is accomplished with an efficiency of at least 80% as compared to heterologous compound production in BJ5464. In some cases, the strain allows production of heterologous proteins with an efficiency of at least 80% as compared to heterologous protein production in BJ5464.

In some embodiments the present disclosure provides a method for isolating a plasmid from a yeast cell, the method comprising: isolating total DNA from a yeast cell that includes a plasmid; incubating the DNA with an exonuclease such that the exonuclease degrades substantially all of the linear DNA in the isolated total DNA from the yeast cell; optionally inactivating the exonuclease; and recovering the plasmid DNA. In some cases, the isolated plasmid DNA is of sufficient purity for use in a sequencing reaction. In some cases, the plasmid DNA is further prepared for a sequencing reaction.

In some embodiments, the present disclosure provides pharmaceutical composition comprising Compound 6 and a pharmaceutically acceptable excipient. In some embodiments, the present disclosure provides pharmaceutical composition comprising Compound 7 and a pharmaceutically acceptable excipient. In some embodiments, the present disclosure provides pharmaceutical composition comprising Compound 8 and a pharmaceutically acceptable excipient. In some embodiments, the present disclosure provides pharmaceutical composition comprising Compound 9 and a pharmaceutically acceptable excipient. In some embodiments, the present disclosure provides pharmaceutical composition comprising Compound 10 and a pharmaceutically acceptable excipient. In some embodiments, the present disclosure provides pharmaceutical composition comprising Compound 11 and a pharmaceutically acceptable excipient. In some embodiments, the present disclosure provides pharmaceutical composition comprising Compound 12 and a pharmaceutically acceptable excipient. In some embodiments, the present disclosure provides pharmaceutical composition comprising Compound 13 and a pharmaceutically acceptable excipient. In some embodiments, the present disclosure provides pharmaceutical composition comprising Compound 14 and a pharmaceutically acceptable excipient. In some embodiments, the present disclosure provides pharmaceutical composition comprising Compound 15 and a pharmaceutically acceptable excipient. In some embodiments, the present disclosure provides pharmaceutical composition comprising Compound 16 and a pharmaceutically acceptable excipient. In some embodiments, the present disclosure provides method of producing Compound 3, the method comprising: providing a vector or vectors comprising the coding sequences of SEQ ID NOs: 200-206; transforming a host cell with the vector or vectors; incubating the host cell in culture media under conditions suitable for the expression of the coding sequences; and isolating the compound produced by the host cell.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The written disclosure herein describes illustrative embodiments that are non-limiting and non-exhaustive. Reference is made to certain of such illustrative embodiments that are depicted in the figures, in which:

FIG. 15B illustrates a polyketide produced by a 5-gene gene cluster.

DETAILED DESCRIPTION

Figure 1A:
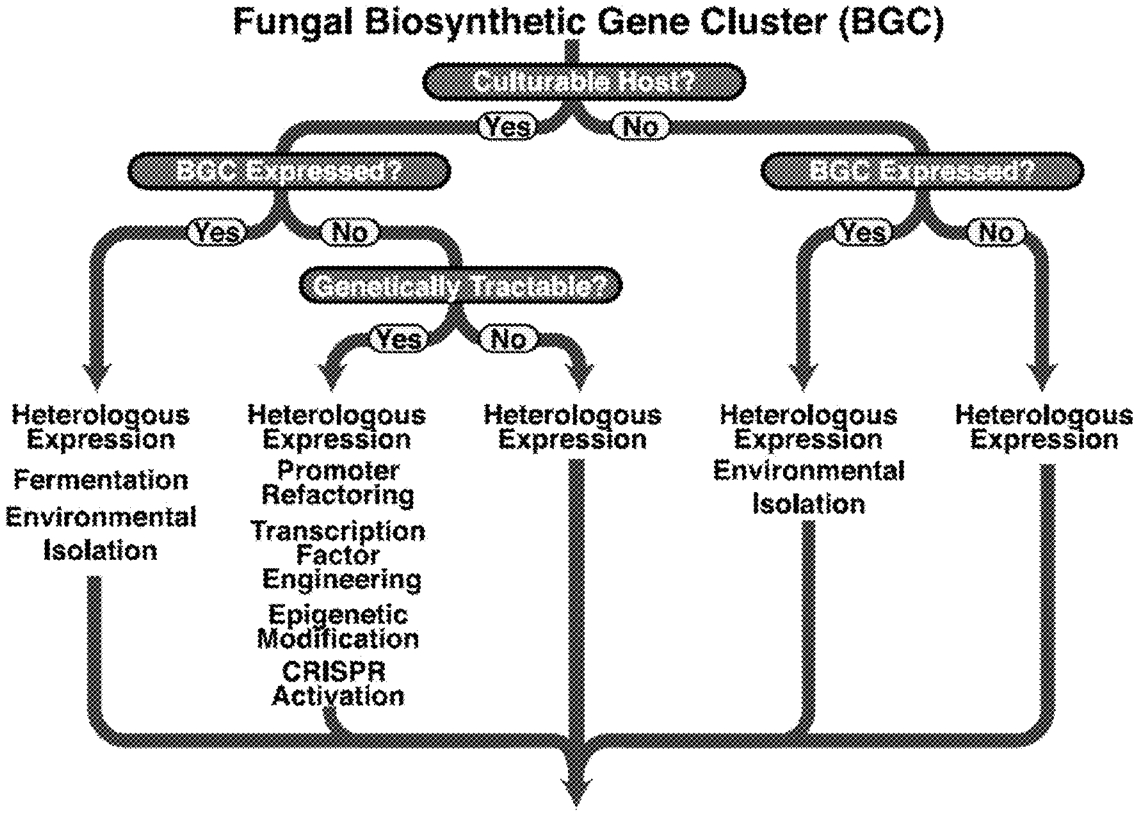
FIG. 1A illustrates strategies that may be used to obtain a secondary metabolite from a fungal strain given different properties of the fungal strain.

Systems and methods in accordance with various embodiments of the disclosure identify, refactor, and express biosynthetic gene clusters in host organisms to produce secondary metabolites. Systems and methods in accordance with various embodiments of the disclosure utilize host organisms to produce secondary metabolites. Using host organisms allows for production of secondary metabolites from biosynthetic gene clusters regardless of whether the native host cell can be cultured, or whether the cluster is expressed in the native host, see FIG. 1A. In some cases, the secondary metabolites may bind to one or more specific proteins. In some embodiments, the host organism ordinarily does not produce the secondary metabolite. The host organism obtains the ability to produce the secondary metabolite due to the introduction of a biosynthetic gene cluster identified using a cluster identification process performed in accordance with an embodiment of the disclosure. In one embodiment, a cluster identification process identifies a biosynthetic gene cluster that possesses characteristics suggesting that it is responsible for producing a secondary metabolite with novel chemistry. In another embodiment, a cluster identification process (discussed further below) identifies a biosynthetic gene cluster that possesses characteristics suggesting that it is responsible for producing a secondary metabolite that binds to a specific protein of interest. In some embodiments this disclosure provides the inclusion of a biosynthetic gene cluster identified using a cluster identification process, in accordance with various embodiments of the disclosure, within a host organism enabling the host organism to express a secondary metabolite. In some cases, the secondary metabolite produced in the host cell may be identical to a secondary metabolite that is naturally produced by the organism in which the biosynthetic gene cluster was originally identified. In some cases, the secondary metabolite produced by the host cell is an analog of a secondary metabolite produced by the organism from which the cluster was identified. In other cases, the secondary metabolite produced in the host cell may be structurally distinct from the secondary metabolite produced by the cluster in the originating species. Differences in the product produced may arise from differences in expression and localization of the coding sequences from the cluster. Additionally coding sequences, or expression products thereof, from the cluster may interact with other coding sequences, or expression products thereof, not contained in the cluster. Host cell produced secondary metabolites which are distinct from those produced in the originating species of the cluster may be termed non-naturally occurring secondary metabolites or non-natural secondary metabolites. The secondary metabolite produced by the host organism can be isolated and then can be used, for example, in a treatment. In some cases, the secondary metabolites may be used in a treatment of a disease or disorder which involves aberrant activity of a specific protein. This disclosure also describes a panel of sesquiterpenoid and polyketide products.

Cluster Identification

Cluster identification processes, in accordance with many embodiments of the disclosure, utilize specific properties of a biosynthetic gene cluster to identify gene clusters of interest from sequence data. Sequence data used with the methods of this disclosure may comprise genomic sequence data, transcriptome sequence data, or other sequence data. In some cases, sequence data may be generated by sequencing a DNA sample obtained from an environmental sample. In other cases, sequence data may be obtained from publically available genome sequence libraries, or may be purchased. Genome sequences may be derived from any organism. In some cases, genome sequences may be derived from a fungal, bacterial, archaeal or plant species.

In some cases, the genome sequences may be derived from fungi. In some cases, the genome sequences may be derived from fungi which are poorly characterized or difficult to culture. In some cases, the genome sequences may be derived from fungi which are well characterized, or partially characterized. Examples of types of fungi from which sequences may be derived include fungi from one of the following Phyla: Basidiomycota, Ascomycota, Neocallimastigomycota, Blastocladiomycota, Glomeromycota, Chytridiomycota and Microsporidia. Examples of fungal species which may be the source of sequence data include, but are not limited to: *Aspergillus tubingensis, Hypomyces subiculosus, Coniothyrium sporulosum, Acremonium* Sp. KY4917, *Aspergillus niger, Thielavia terrestris, Trichoderma virens, Pseudogymnoascus pannorum, Scedosporium apiospermum, Metarhizium anisopliae, Cochliobolus heterostrophus, Verruconis gallopava, Moniliophthora roreri, Punctularia strigosozonata, Hydnomerulius pinastri, Arthroderma gypseum, Setosphaeria turcica, Pyrenophora teres, Cladophialophora yegresit, Talaromyces cellulolyticus, Endocarpon pusillum, Hypholoma sublateritium, Ceriporiopsis subvermispora, Botryotonia cinerea, Formitiporia mediterranea, Heterobasidion annosum, Gelatoporia subvermispora, Dichomitus squalens, Pleurotus ostreatus, Schizophyllum commune, Stereum hirsutum, Sternum hirsutum*, and *Dacryopinax primogenitus*.

Figure 1B:
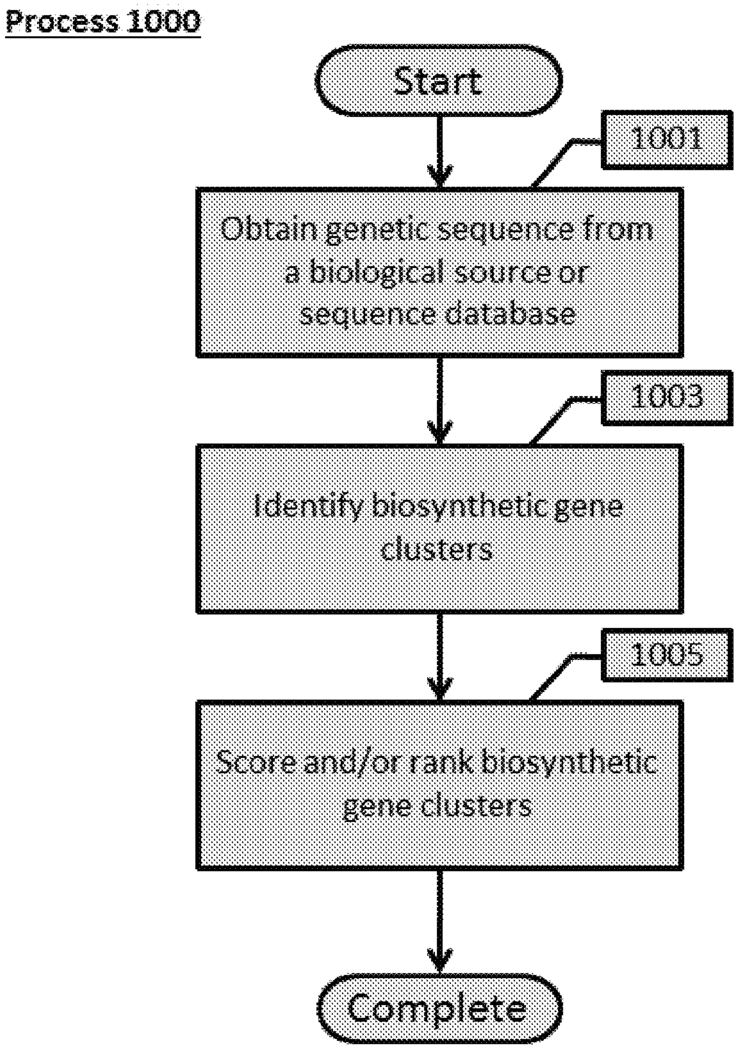
FIG. 1B provides a flowchart illustrating a process for identifying and ranking biosynthetic gene clusters.

Provided in FIG. 1B is a flow chart showing a process embodiment that can be implemented using computer systems for identifying and ranking BSGs that are likely to produce secondary metabolites capable for anthropogenic use (e.g., medicinal). As shown, Process 1000 can begin by obtaining genetic sequence data from a biological source or sequence database (1001). In some cases, the sequence data may be derived from single cell sequencing of a fungal cell of unknown species. For example an environmental sample may contain many different cells which may be separated and sequenced. In some cases, the sequence data is obtained from a publically available genetic data library, or may be purchased. Often the genetic sequence data is a genomic sequence of an organism, however, any genetic data sequence, including partial genome sequence data, may be used.

Figure 1C:
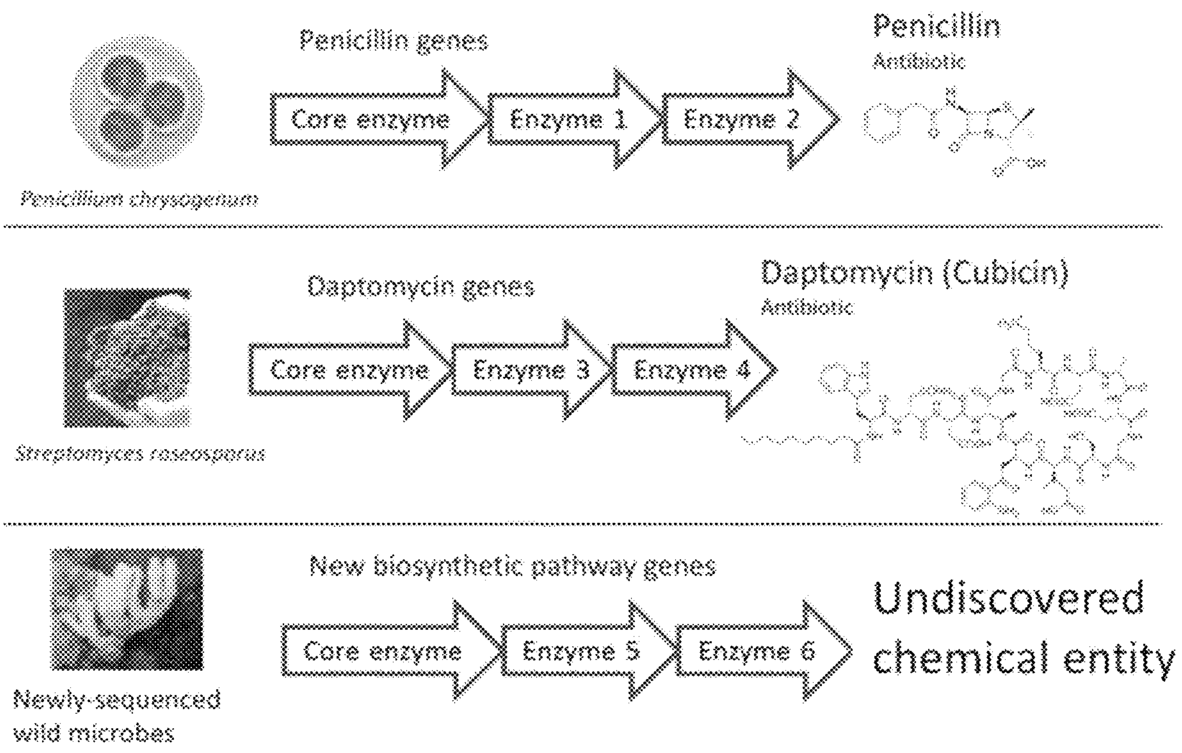
FIG. 1C illustrates examples of characterized gene clusters which produce known chemicals and a novel gene cluster with a product.

Process 1000 also identifies biosynthetic gene clusters (1003). Clusters may be identified using bioinformatics methods to scan genome sequences. Characteristics of a gene cluster may include a grouping of two or more genes within about 5 kb, 10 kb, 15 kb, 20 kb, 25 kb, 30 kb, 35 kb, 40 kb or 45 kb of each other. Genes may be bioinformatically identified by the presence of known promoter sequences, transcription initiation sequences, or homology to known genes or gene features. The term homology as used herein refers to sequences with high sequence identity, for example a sequence identity of at least about 50%, 60%, 70%, 80%, 90%, 95%, 97%, 98%, 99% or more than 99%. Sequence identity may be determined using alignment tools such as Basic Local Alignment Search Tool (BLAST), available via the National Center for Biotechnology Information (NCBI), to determine areas of conserved sequence. Biosynthetic gene clusters may be identified using a bioinformatics tool, such as ClustScan, SMURF, CLUSEAN, and/or antiSMASH. Biosynthetic gene clusters typically contain one or more core biosynthetic genes and one or more tailoring genes. Clusters which contain the same, or highly similar, core enzymes with different tailoring genes may produce quite different compounds, as seen in FIG. 1C. Expressing a subset of genes from a cluster may also result in production of a different compound compared with the compound produced by expression of all the genes in the cluster.

Process 1000 also scores and/or ranks gene clusters utilizing various factors (1005). In some cases, scores and rankings are based on the type of secondary metabolite to be produced. In other cases, scores and rankings are based on a protein or domain existing within the cluster. In even more cases, the level of homology of a particular protein within the cluster to a protein of interest is considered. It should be understood that many different factors can be used, as determined by the application and use of the biosynthetic gene cluster data.

Figure 1D:
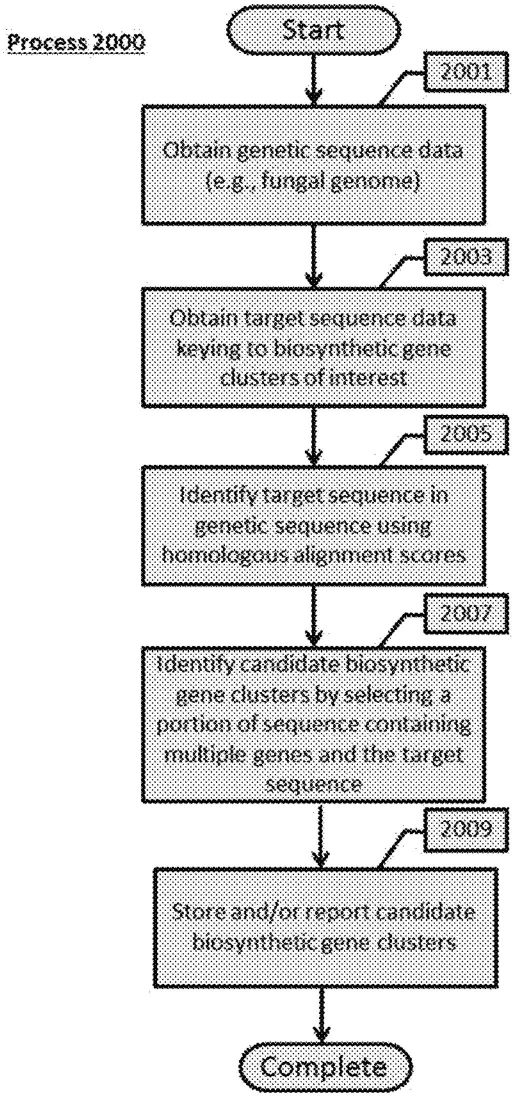
FIG. 1D provides a flowchart illustrating a process for identifying biosynthetic gene clusters.

An embodiment of a process for identifying biosynthetic gene clusters using computer systems is provided in FIG. 1D. Process 2000 can begin with obtaining genetic sequence data of an organism having gene clusters (2001). In many cases, the genetic sequence data is a genomic sequence of an organism. In other cases, the genetic data sequence is a partial genome sequence data. In addition to genetic sequence data, Process 2000 also obtains target sequence data keying to biosynthetic gene clusters of interest (2003). The target sequence is any sequence the user wishes to define and identify clusters. In some cases, the target sequence is a particular protein domain of interest. In other cases, the target sequence is a particular protein, protein homolog or protein class.

In some embodiments, clusters are scanned for the presence of genes encoding proteins known to be involved in biosynthetic pathways. Key proteins involved in biosynthetic pathways include terpene synthases, polyketide synthases (PKSs, both highly-reducing and non-reducing), non-ribosomal peptide synthetases, UbiA-type terpene cyclases (UTCs), polyketide synthase non-ribosomal peptide synthetase hybrids, and dimethyl allyl transferases (see FIG. 2).

Process 2000 also identifies the target sequence within genetic sequence data using homologous alignment scores (2005). Using an appropriate application, the sequence of the target is used to align to the genetic sequence data, looking for a threshold of homology. In some cases, a positive homologous event occurs when the target sequences aligns with the a portion of the genetic sequence having homology of at least about 50%, 60%, 70%, 80%, 90%, 95%, 97%, 98%, 99% or more than 99%. Sequence homology may be determined using any alignment tool, such as, for example BLAST.

Using the homologous alignment scores, candidate biosynthetic gene clusters may be identified in the region surrounding the homologous event (2007). In many cases, the proximal upstream and downstream genes are examined to determine and define a gene cluster. In some of these cases, 5, 6, 7, 8, 9, 10 or more proximal genes in either direction are examined. In addition or alternatively, a gene cluster may be defined by genetic distance of the homologous event. Gene clusters may also be defined using a bioinformatics tool, such as ClustScan, SMURF, CLUSEAN, and/or antiSMASH. Once identified and defined, clusters may be stored as data and/or reported via an output interface (2009).

Figure 1E:
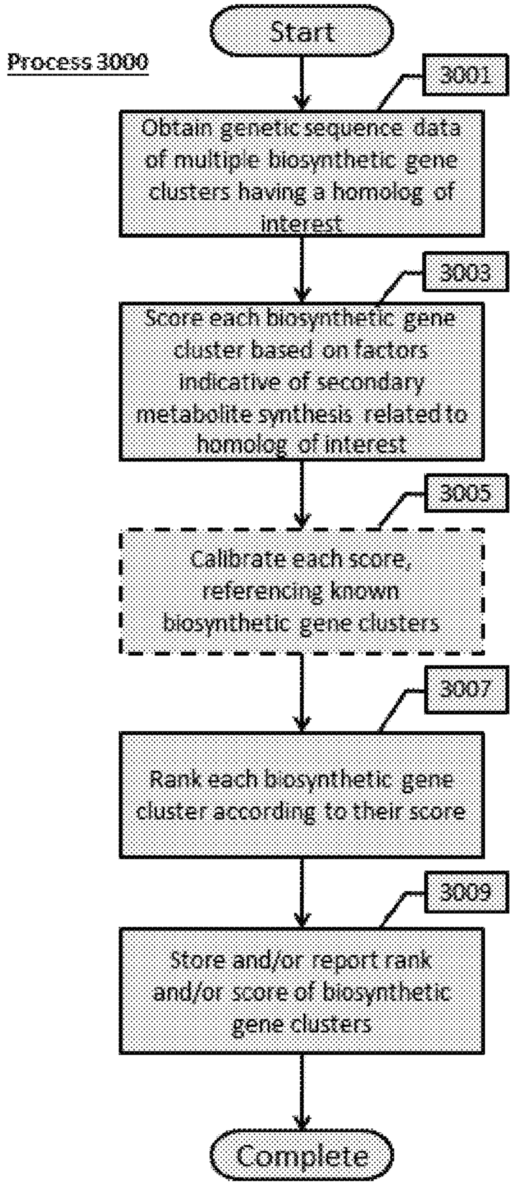
FIG. 1E provides a flowchart illustrating a process for ranking biosynthetic gene clusters.

An embodiment for ranking biosynthetic gene clusters using computer systems is provided in FIG. 1E. As shown, Process 3000 can begin with obtaining genet sequence data of multiple biosynthetic gene clusters. In this process, the clusters obtained each have a homolog protein of interest. The homolog of interest depends on the user's desired result. In many cases, the homolog of interest has a human ortholog that is known to be involved in a human condition, disorder, or disease. In some of these cases, the human ortholog is known to have mutations, either congenital or somatic, that lead to a condition, disorder, or disease. In some other of these cases, the human ortholog is involved in biological pathways that are involved in a condition, disorder, or disease. In other cases, the homolog of interest has an ortholog in an infectious species, including, but not limited to bacterial, fungal, protozoan species. In many of these cases, the ortholog in the infectious species is essential to the vitality of the organisms of the species. In some other of these cases, the ortholog in the infectious species is involved in producing a toxin. Furthermore, in many cases, the user has a desired result to prioritize clusters that will produce a secondary metabolite that may target the of human or infectious species ortholog.

Identifying a gene cluster that may produce a secondary metabolite that binds a target protein may involve multiple different steps. In some cases, such a gene cluster may be identified by the presence of one or more genes encoding a homolog of the target protein, within or adjacent to the cluster, as determined by a homology search (for example, using the tblastn algorithm, with a maximum score granted when one homolog is found). In some cases, a gene cluster may be identified by the confidence in homology of the target to a gene or genes in a cluster. For example, according to the tblastn algorithm, gene clusters containing a gene with an e value less than about $10^{-10}$, $10^{-20}$, $10^{-30}$, $10^{-35}$ or $10^{-40}$ may be selected. Gene clusters may also be selected using a protein blast method such as blastp to compare a predicted protein sequence against either known protein sequence or other predicted protein sequence. For blast searches using a known or predicted protein sequence gene clusters containing a gene with an e value less than about $10^{-10}$, $10^{-20}$, $10^{-30}$, $10^{-35}$ or $10^{-40}$ may be selected. Selected gene clusters may be prioritized with increasing priority scores for lower e-values. In some cases, a gene cluster may be identified by the fraction of the homologous gene that meets a certain threshold of identity (for example, with an increasing score for more identity, and a lower bound threshold of at least about 99%, 95%, 80%, 85%, 75%, 70%, 65%, 60%, 50%, 45%, 40%, 35%, 30%, 25%, 20% or 15% coverage). In some cases, a gene cluster may be selected if it contains a gene which produces a protein with at least about 20%, 30%, 40%, 50%, 60%, 70%, 80%, 90%, 95%, 97%, 98%, 99% or 100% homology to the target protein. In some cases, a protein that is encoded by the region that is included in, or positioned proximal to, a BGC may be identical to, or have at least about 30%, 40%, 50%, 60%, 70%, 80%, 90%, 95%, 99% or about 100% homology to a target protein. In some cases, a gene cluster may be identified by the total number of genes homologous to the target protein present in the entire genome of the organism (for example, with a maximum score granted to cases with 2-4 homologs per genome). In some cases, a gene cluster may be identified by the homology of the gene in, or adjacent to, the cluster to the target protein (for example, using the blastx algorithm, with a maximum score granted when the gene in the biosynthetic gene cluster's closest homolog in the target protein's genome is the target protein itself). In some cases, a gene cluster may be identified by the phylogenetic relationship of the target protein to the gene in the cluster (for example, with an increasing score for homologs in the gene cluster that clade with the target protein, with confidence assigned by a bootstrap test or Bayesian inference of phylogeny, and a lower bound threshold defined as homologs in a phylogenetic context that appear in a clade with bootstrap value of 0.7 or Bayesian posterior probability of 0.8). In some cases, a gene cluster may be identified by the expected number of homologs of the target in or adjacent to the biosynthetic cluster (for example, with a greater score the lower the probability of a homolog of the target being present in or adjacent to a biosynthetic cluster of a certain size, given the number of total homologs in the genome, as determined by a permutation test). In some cases, a gene cluster may be identified by the likelihood that the target protein is essential for viability, growth, or other cellular processes in the native environment (for example, through evidence that deletion of homologs in related organisms (such as *S. cerevisiae*) render the organism inviable). In some cases, a gene cluster may be identified by one or more of the above methods, or by any two or more of the above methods.

Utilizing identification steps, Process 3000 also scores each biosynthetic gene cluster based on factors indicative of secondary metabolite synthesis related to the homolog of interest (3003). Accordingly, a score is constructed for each biosynthetic cluster based on one or more of the following:

(a) the presence of one or more homologs of target orthologs within or adjacent to the cluster, as determined by a homology search (e.g., the BLAST algorithm);
(b) the degree of homology of one or more target orthologs to genes in a cluster (e.g., as defined by the e-value);
(c) the fraction of the homologous gene that meets a certain threshold (e.g., the number of homologous protein domains);
(d) the total number of genes homologous to the target ortholog present in the entire genome of the organism;
(e) the degree of homology of a gene in or adjacent to the cluster to the target ortholog
(f) the number of homologs in the gene family (e.g., the number of homologs of a human target gene in the human genome); and/or
(g) the expected number of homologs of the target ortholog in, or neighboring, a biosynthetic cluster (e.g., the probability of a homolog of the target being present in or adjacent to a biosynthetic cluster of a certain size, given the number of total homologs in the genome, and as determined from a permutation test)
(h) the synteny of the gene cluster with related species (e.g., conservation of gene cluster)
(i) the function class of the target ortholog
(j) the presence of specific promoters adjacent to the homolog(s) within the gene cluster (e.g., identification of bidirection promoter upstream the homolog and biosynthetic gene)
(k) the presence of specific regulatory elements in the biosynthetic cluster (e.g., the number of transcription factor binding sites shared among target orthologs and homologs/biosynthetic genes in the cluster)
(l) the presence of homologs outside the cluster that are co-regulated with some or all the genes within the biosynthetic cluster
(m) the presence of protein- and DNA-sequence derived features within the clusters that have successfully been shown to produce secondary metabolites. It should be understood that a particular user may desire to use one, some, or all the factors listed here, and/or other factors not listed. The factors utilized depend on the user's application and desired result.

Process 3000 also has the option to calibrate the score to by referencing a set of "true positives" (i.e., cases where there is one or more known targets in or adjacent to a biosynthetic cluster that produces a small molecule targeting the target, such as the lovastatin BGC) (3005). The output of this process may be a ranked and/or scored list of biosynthetic clusters, which may be used to identify the clusters that will produce therapeutic small molecules targeting the products of a disease-related gene (3007). The ranked and/or scored list of clusters can be stored as data or reported via an output interface (3009).

Figure 1F:
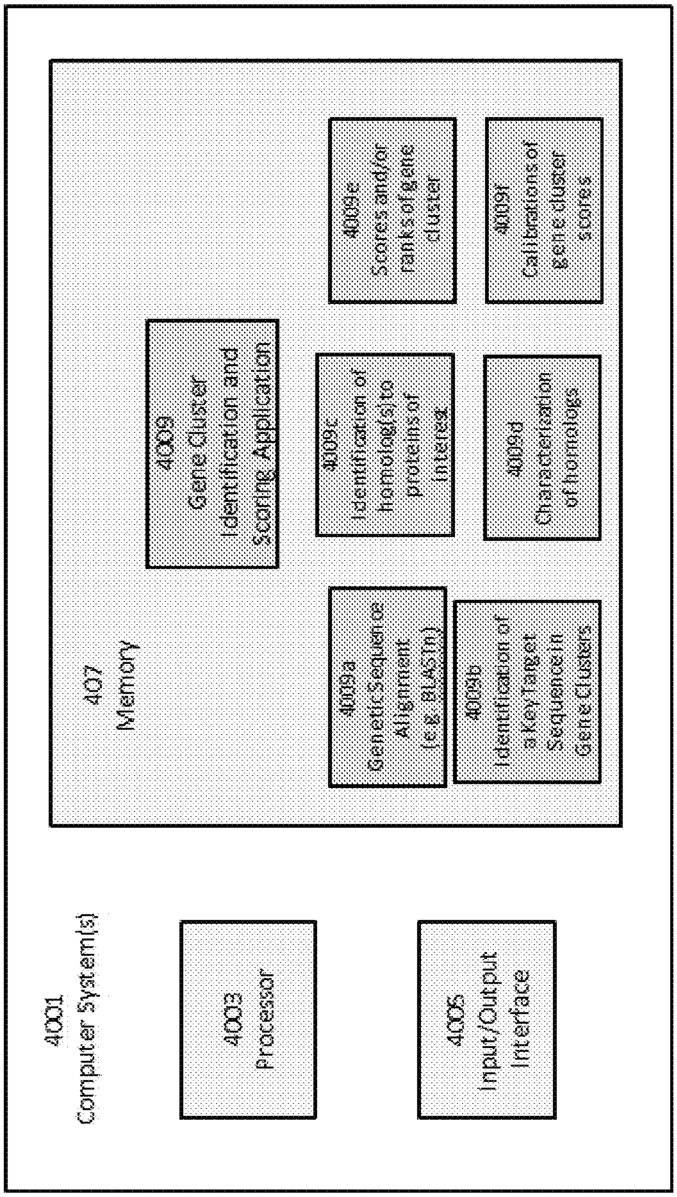
FIG. 1F provides an illustration of computer systems for implementing processes for identifying and ranking biosynthetic gene clusters.

Turning now to FIG. 1F, computer systems (4001) may be implemented on a single or multiple computing devices in accordance with some embodiments of the invention. Computer systems (4001) may be personal computers, laptop computers, and/or any other computing devices with sufficient processing power for the processes described herein. The computer systems (401) include a processor (403), which may refer to one or more devices within the computing devices that can be configured to perform computations via machine readable instructions stored within a memory (4007) of the computer systems (4001). The processor may include one or more microprocessors (CPUs), one or more graphics processing units (GPUs), and/or one or more digital signal processors (DSPs). According to other embodiments of the invention, the computer system may be implemented on multiple computers.

In a number of embodiments of the invention, the memory (4007) may contain a gene cluster identification and/scoring application (4009) that performs all or a portion of various methods according to different embodiments of the invention described throughout the present application. As an example, processor (4003) may perform a gene cluster identification and/or scoring method similar to any of the processes described above with reference to FIGS. 1D and 1E, during which memory (4007) may be used to store various intermediate processing data such as the genetic sequence alignment data (e.g., BLASTn) (4009*a*), identification of key target sequences with gene clusters (4009*b*), identification of homolog(s) to a protein of interest (4009*c*), characterization of homologs (4009*d*), scores and/or ranks of gene clusters (4009*e*), and calibration of gene cluster scores (4009*f*).

In some embodiments of the invention, computer systems (4001) may include an input/output interface (4005) that can be utilized to communicate with a variety of devices, including but not limited to other computing systems, a projector, and/or other display devices. As can be readily appreciated, a variety of software architectures can be utilized to implement a computer system as appropriate to the requirements of specific applications in accordance with various embodiments of the invention.

Although computer systems and processes for chimeric sequence unveiling and performing actions based thereon are described above with respect to FIG. 1F, any of a variety of devices and processes for data associated with cluster identification and/or scoring as appropriate to the requirements of a specific application can be utilized in accordance with many embodiments of the invention.

Figure 2:
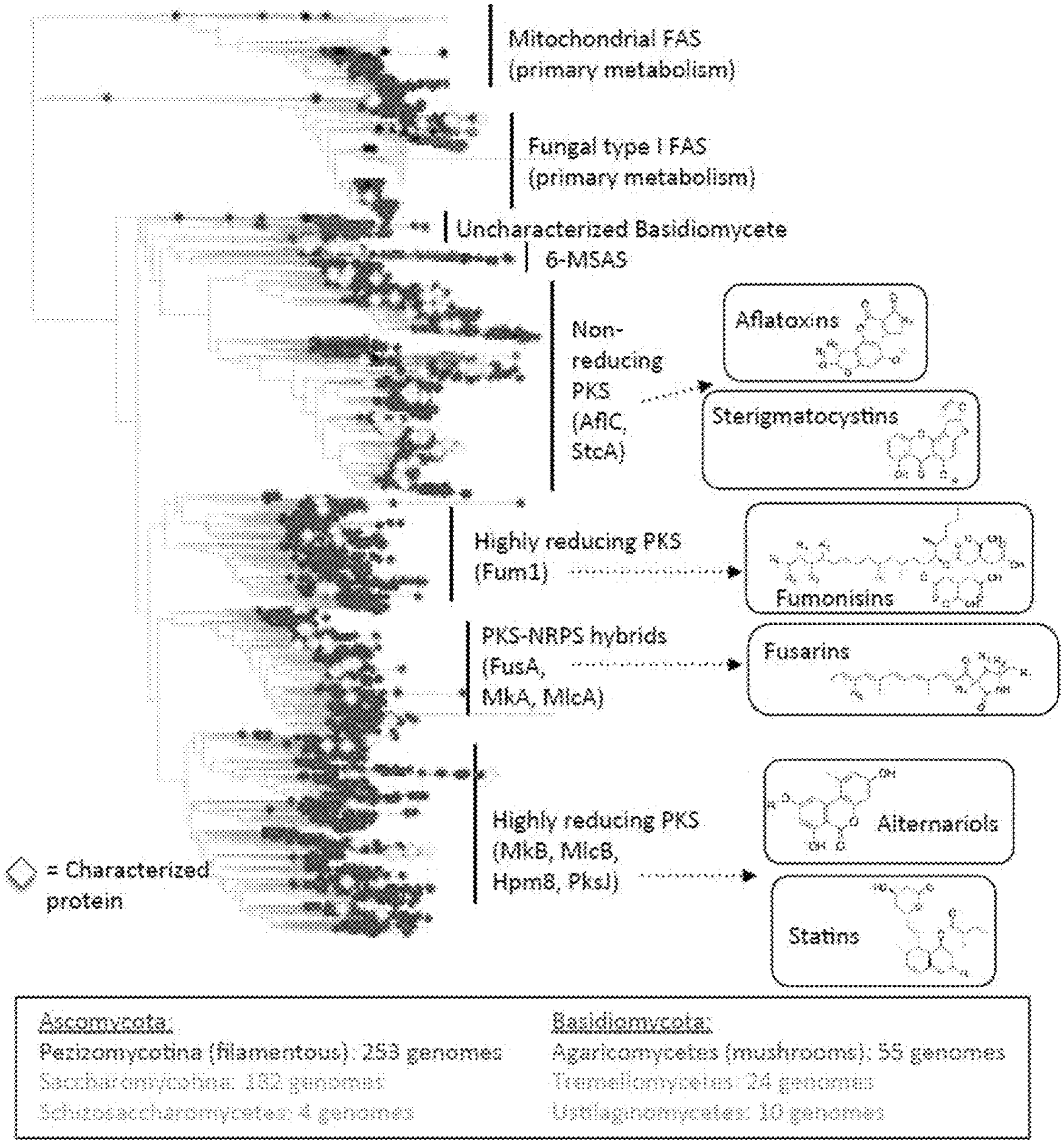
FIG. 2 illustrates a phylogenetic analysis of enzymes that produce secondary metabolites.

In some embodiments, gene sequences within a novel cluster, or a set of novel clusters, may be compared to gene sequences from known and characterized biosynthetic gene clusters. In some cases, phylogenetic comparisons may be carried out between gene sequences in a novel cluster and gene sequences from characterized gene clusters. As shown in FIG. 2, of the many biosynthetic enzymes which have been identified from sequence data, only a small fraction have been characterized, suggesting potential for many novel chemistries. Phylogenetic analysis may be performed on the core biosynthetic gene or genes, or on one or more tailoring genes of the novel cluster. Preferred clusters may be clusters containing one or more gene sequences which do not share a close phylogenetic relationship with a sequence from a characterized gene cluster. In some cases, gene clusters may be ordered according to their phylogenetic relationship to characterized gene clusters, clusters with the most distant relationships may be preferred for further analysis.

Figure 3:
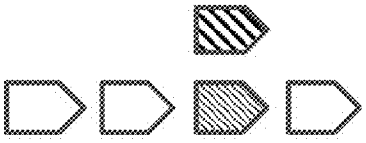
FIG. 3 illustrates self-resistance mechanisms for potentially toxic secondary metabolites.
Figure 3:
Figure 3:
Figure 4:
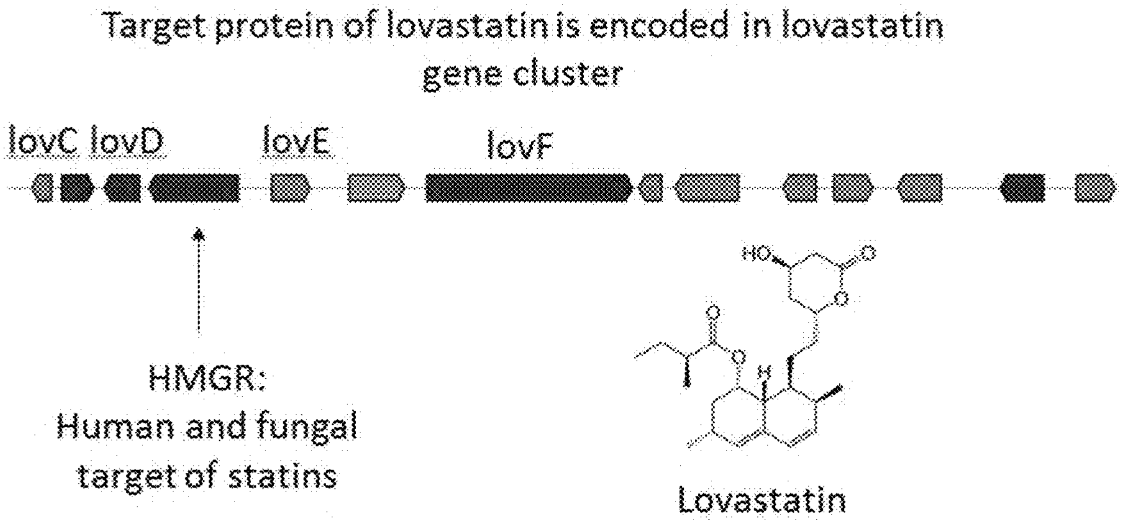
FIG. 4 illustrates a gene cluster that produces lovastatin.

In several embodiments, a specific secondary metabolite is used as a weapon against another organism (i.e., is toxic to or inhibits the growth of specific type of organism). In many instances, the toxic secondary metabolite may also be toxic to the organism that produces the secondary metabolite. Accordingly, the producing organism may defend against self-harm in a number of ways including (but not limited to) pumping the secondary metabolite out of the cell, enzymatically negating the secondary metabolite, or producing an additional version of the protein targeted by the secondary metabolite that is less sensitive or insensitive to the secondary metabolite, (see FIG. 3). In instances in which an organism produces an additional version of the target protein, the "protective" version of the gene that encodes the additional version of the target protein that is less sensitive to the secondary metabolite is often colocalized with the biosynthetic gene cluster, for example the HMGR gene in the lovastatin cluster shown in FIG. 4. Although different to the gene that produces the target protein, the protective version of the gene should produce a protein that maintains detectable homology to the target protein. In several embodiments, the cluster identification process takes advantage of this homology to identify those biosynthetic gene clusters that contain or are adjacent to a gene that encodes a protective homolog of the target protein. In a number of embodiments of the disclosure, the genetic sequences of multiple organisms are analyzed to detect biosynthetic gene clusters possessing this characteristic.

Figure 15A:
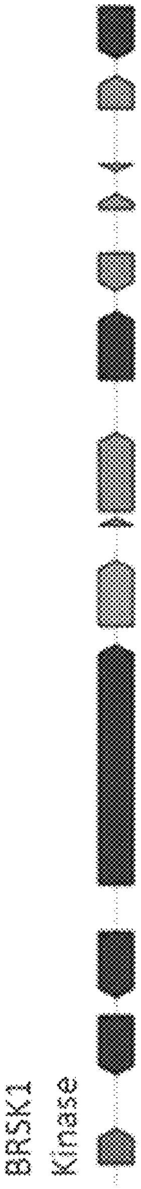
FIG. 15A illustrates an example gene cluster.
Figure 15A:
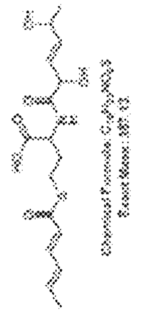

A target protein may be any protein of interest which has a homolog in the genome sequence/s from which the gene clusters were obtained. In some cases, the target protein is an enzyme. In some cases, the target protein is a signaling protein. In some cases, the target protein is one which is required by the species of origin. For example, the target protein may be one which contributes to viability of growth of the cell, and deletion or inactivation of the target protein from the cell may have deleterious effects on the viability or growth of the cell. In some cases, the target protein may have a vertebrate or mammalian homolog. In some cases, the target protein has a human homolog. The human homolog may be a protein which is dysregulated in a disease. An example of a gene cluster which was identified using methods disclosed herein, and which comprises a homolog of the BRSK1 gene is shown in FIG. 15A.

In some embodiments, a biosynthetic cluster of interest which produces a secondary metabolite that interacts with a target protein may also produce a protein for inactivating the secondary metabolite or for secreting the secondary metabolite from the cell in which it is produced. A protein which inactivates the secondary metabolite may be omitted when designing an expression construct to express this cluster in a host cell. A protein involved in secreting the secondary may be included or omitted when designing an expression construct to express this cluster in a host cell. To identify such clusters several approaches may be used. For example a set of biosynthetic gene clusters may be identified from genome data and the identified clusters may be analyzed for the presence of enzymes with activities that may be useful for degradation of a secondary metabolite. In another example, a set of biosynthetic gene clusters may be analyzed for the presence of proteins involved in transport or secretion pathways. In another example a homology search may be identified across one or more genome sequences to find genes encoding proteins homologous to an enzyme known to degrade a toxic compound. Once such genes have been identified they may be analyzed for proximity to a biosynthetic gene cluster. Proximity to a gene cluster may be defined as within about 50 kb, 40 kb, 30 kb, 20 kb, 10 kb, 5 kb, 1 kb, or less than 1 kb.

In some embodiments, a gene cluster which produces a secondary metabolite that may be toxic to the host cell may also contain signals to direct the production of the secondary metabolite to a specific cellular location. In some cases, the enzymes may be membrane tethered to the intracellular or extracellular side of a cell membrane, or may be secreted through a membrane to the intracellular or extracellular side (including the insides of organelles and vacuoles). For example, the enzymes of the cluster may contain membrane-targeting signals to target the enzymes to either the extracellular membrane or to an intracellular organelle or vacuole. In some cases, the enzymes may be targeted to the extracellular membrane in an orientation which results in the active region of the enzyme being inside of an organelle or vacuole. In some cases, the enzymes may be targeted to the extracellular membrane in an orientation which results in the active region of the enzyme being outside of the cell. Such clusters may be identified by analyzing the predicted proteins of the cluster for the presence of peptide targeting signals or of terminal sequences with homology to targeting signals.

In some cases, a genome or genomes may be searched for gene clusters and the set of identified gene clusters may be searched for genes which are homologous to a target gene, or which produce proteins homologous to a target protein. In other cases, a genome or genomes may be searched for a gene or genes homologous to a target gene, and the identified genes may be analyzed for association with a gene cluster. In other cases, a genome or genomes may be searched for gene clusters and the set of identified gene clusters may be phylogenetically analyzed to determine relationships between the identified gene clusters and known, characterized, gene clusters. In yet other cases, a novel genome or genomes may be searched for sequences distantly homologous to a known biosynthetic enzyme, and the identified genes may be analyzed for association with a gene cluster.

Specific secondary metabolites synthesized using methods in accordance with a number of embodiments of the disclosure and the proteins utilized to identify the biosynthetic gene clusters used to synthesize the secondary metabolites and targeted by the secondary metabolites are described herein. An example of a method which may be used to produce a secondary metabolite is shown in FIG. 5. As shown in an exemplified embodiment process in FIG. 5A, Process 100 generates and extracts a heterologous compound for use. Exemplary Process 100 can begin by searching genetic data of various organismal species for pathways or BGCs that produce a compound product (101). The organismal species used in this step can be any species. For example, fungal and bacterial species often contain multiple BGC pathways that are encoded in its DNA. Likewise, the genetic data to be searched can be any genetic data available or determinable by the user. Accordingly, on one end of the spectrum, the genetic data may be a fully annotated, publicly available genome of a well-studied species (e.g., *Penicillium notatum*). On the other end of the spectrum, the genetic data may be a publicly unavailable, partial genomic sequence of a newly discovered species incapable of anthropogenic cultivation, wherein the partial sequence is found to have a gene cluster that may produce a compound.

Exemplary embodiment Process 100 may continue by using the genetic data to reconstruct the compound product pathway in an acceptable genetic expression system (103). Often, to reconstruct the compound pathway, the genetic data is used to create nucleic acid molecules (e.g., DNA) comprising the coding sequences of the pathway genes sufficient to produce the product in the acceptable genetic expression system. The nucleic sequences are to be transferred into the expression system. Expression systems are any organism capable of producing the heterologous compound by heterologous expression of the pathway genes. Typical expression systems include (but are not limited to) *E. coli* and *S. cerevisiae*.

Once the compound product pathway is reconstructed and transferred within an expression system, the expression system produces the compound (105) in exemplary Process 100. Typically, production of the compound results from coordinated expression of the pathway genes in the expression system. The coordinated expression of the pathway genes results in the production of the enzymes primarily responsible for constructing the heterologous compound product.

Figure 5A:
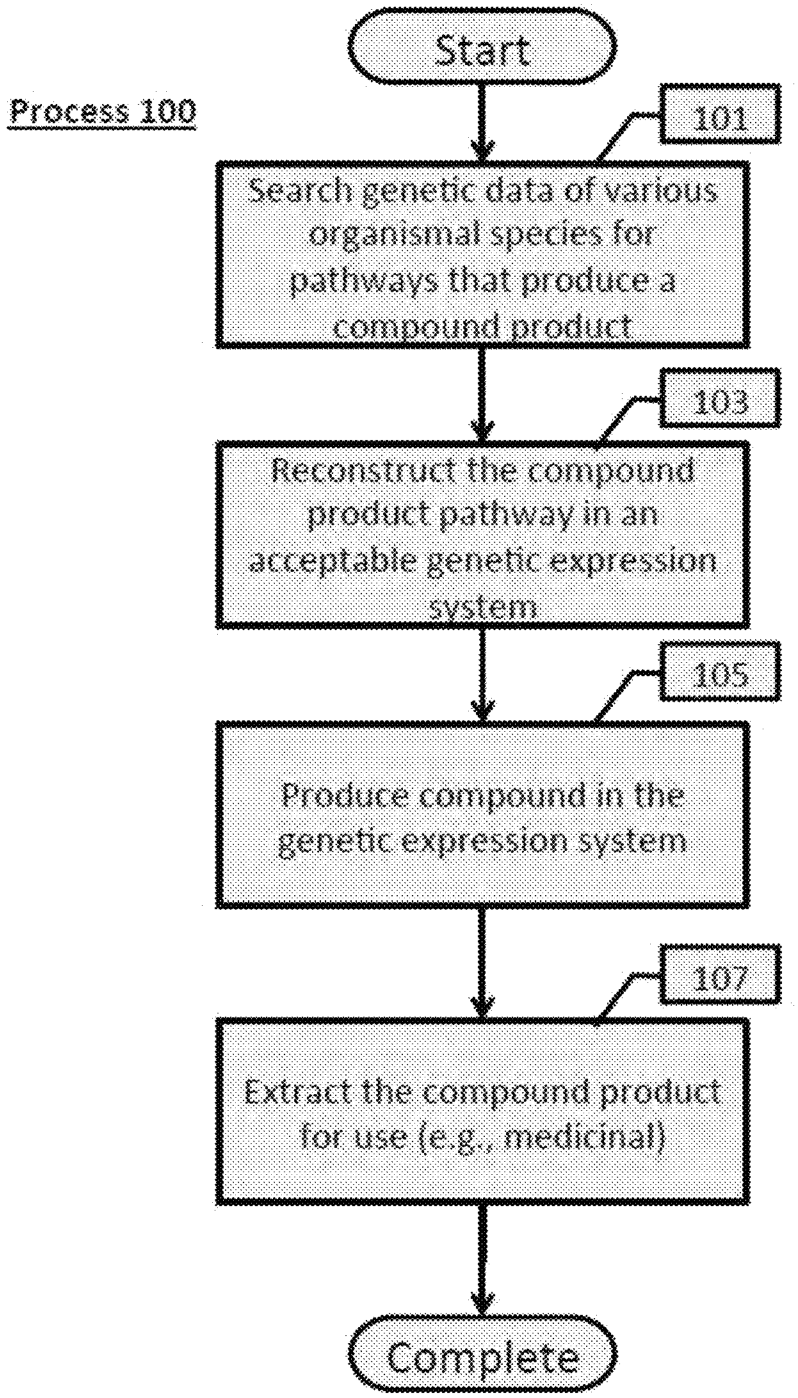
FIG. 5A illustrates an exemplary process to extract and utilize compound products in accordance with an embodiment of the invention.
Figure 5B:
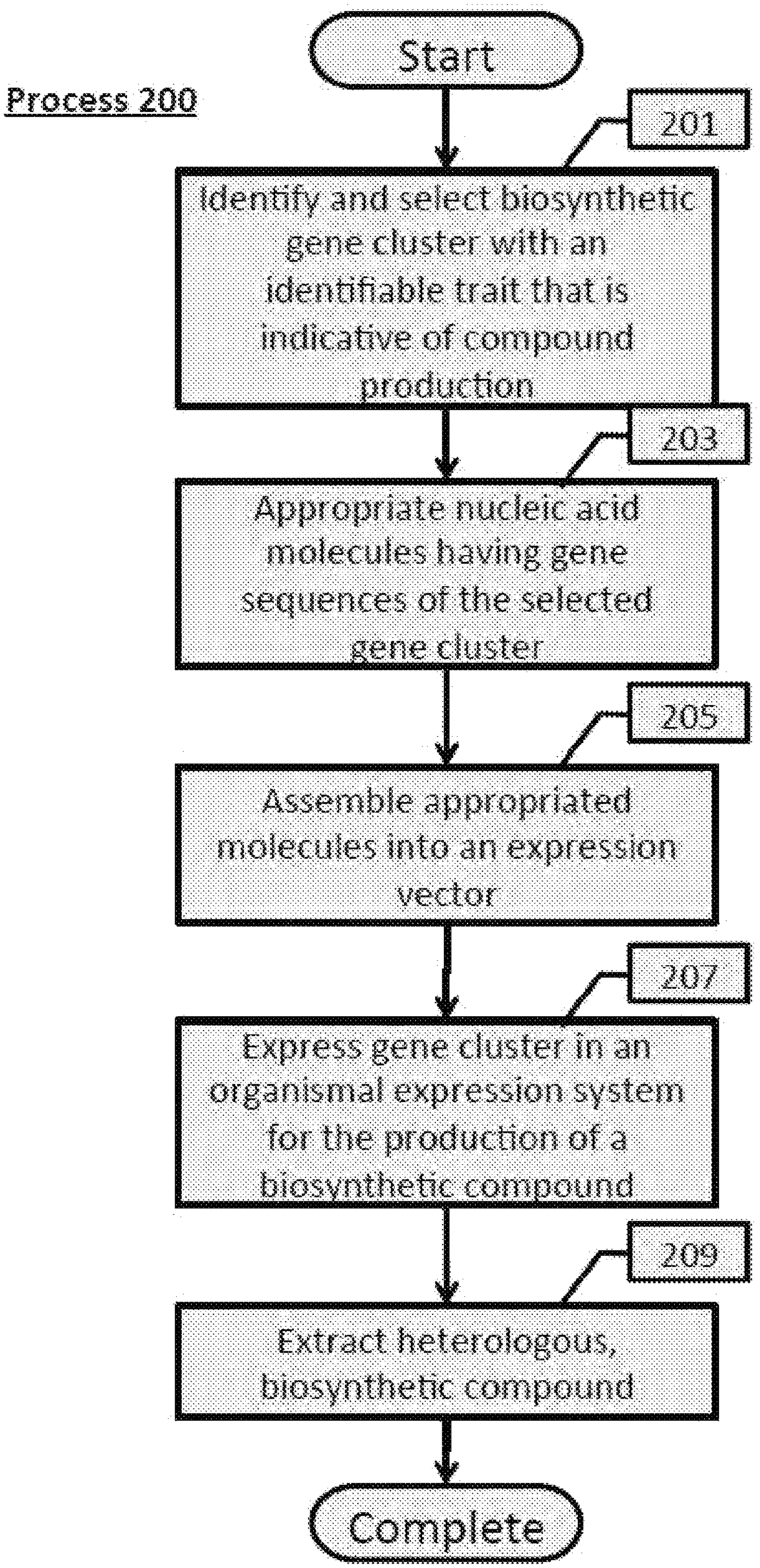
FIG. 5B illustrates an exemplary process to produce and extract heterologous, biosynthetic compound products in accordance with an embodiment of the invention.

FIG. 5B depicts another exemplary embodiment process. Exemplary Process 200 produces, extracts, and characterizes a biosynthetic compound derived from heterologous expression of a gene cluster. The process may begin with the identification and selection of a gene cluster with an identifiable trait that is indicative of compound production (201). Several indicative processes to select gene clusters exist, including several computer-implemented programs. One such program is antiSMASH2.0, which is platform for mining BGC clusters for production of secondary metabolites that searches for core structures to identify putative BGCs (K. Blin, et al. Nucleic Acids Res. 41:W204-12, 2013, the disclosure of which is incorporated herein by reference in its entirety). Another such method is described herein which utilizes homolog sequences within a proximal region in the genome to identify putative BGCs. It should be noted that many other methodologies could be used to select BGCs.

Once a gene cluster has been selected, Process 200 continues by appropriating nucleic acid molecules with the coding sequences of the various genes within the cluster (203 in FIG. 5B). Typically, the nucleic molecules are DNA, but other nucleic molecules (e.g., RNA) can be used for certain applications. When extracting gene sequence data from the host organism, it is usual to remove the non-translated portions (e.g., UTRs, introns) from the gene, leaving only the coding sequence, but the non-translated portions may also be used, especially if they provide a beneficial characteristic. Appropriation of the nucleic molecules can be performed by many different methods including (but not limited to) direct extraction from the host, chemical synthesis, and/or cDNA generation methods (e.g., reverse transcription of host RNA). Regardless of the method used, the resulting nucleic acid molecules may be available to build into expression vectors for heterologous expression.

Exemplary Process 200 utilizes the appropriated nucleic acid molecules to assemble expression vectors for expression in an appropriate organismal expression system (e.g., *E. coli, S. cerevisiae*). Expression vectors are nucleic acid molecules that have the necessary components to express a heterologous gene in the expression system. Common expression vectors are plasmid DNA and viral vectors, but also include kits of DNA molecules that can be joined together to form a longer DNA molecule by a recombination methodology (e.g., yeast homologous recombination (YHR)).

To express a heterologous gene from an expression vector, an expression cassette is may be used, which comprises the sequences of an appropriate promoter and an appropriate terminator along with the heterologous gene sequence. The promoter is typically located upstream of the heterologous gene and can regulate the gene's expression. Many different types of promoters can be used. The selection of the appropriate promoter depends on the application and expression profile desired. For example, in the *S. cerevisiae* expression system, production-phase promoters may express heterologous genes only in the production-phase of the yeast culture's life cycle, which may have desirable properties. For more description of production-phase promoters, please refer to the related U.S. patent application Ser. No. 15/469,452 ("Inducible Production-Phase Promoters For Coordinated Heterologous Expression in Yeast"), the disclosure of which is incorporated herein by reference in its entirety. However, it should be understood, that constitutive promoters and other response-driven promoters could be used within the system.

The sequences of promoters to be used in an expression vector can be derived from various sources. *E. coli* expression systems often use the T7 promoter derived from the T7 bacteriophage because the promoter reliably produces high expression in *E. coli*. Endogenous promoter sequences (e.g., the lac operon in *E. coli*) are expected to perform well within the organismal expression system.

Expression vectors often have other sequences that benefit duplication, selection and stability of the vector within the organismal expression system, in addition to the expression cassette. In several instances, some of these sequences are necessary for maintenance in the expression system. For example, plasmid vectors within an *E. coli* or *S. cerevisiae* host require a host origin of replication and a selectable marker. The origin of replication signals the host expression system to replicate the plasmid vector in order to produce more copies of the plasmid as the host cells duplicate and divide. The selectable marker ensures that only the host cells that contain the vector continue to survive and propagate. Accordingly, these sequences may be necessary for viable heterologous expression.

Once the expression vector is assembled, the heterologous BGC genes are expressed using the organismal expression system (207). Accordingly, the expression vector is to exist within the organismal host such that the host will express the heterologous BGC genes to produce the encoded enzymes. The enzymes produce a biosynthetic compound. This compound is be extracted from the expression system (209).

Extracted heterologous biosynthetic compounds can be characterized to determine their various structures and conformations. Some resultant products may have a solitary structure and conformation while other products will have several different structures with multiple conformations. The various structures and conformations can be determined using mass spectrometry, chromatography, and/or other methods.

There are numerous classes of biosynthetic compounds. For example, polyketides and terpenes are a class of compounds derived from various organismal species. Many novel biosynthetic compounds are likely to have beneficial properties, as a multitude of biosynthetic compounds have been found to be useful in several industries.

Figure 5C:
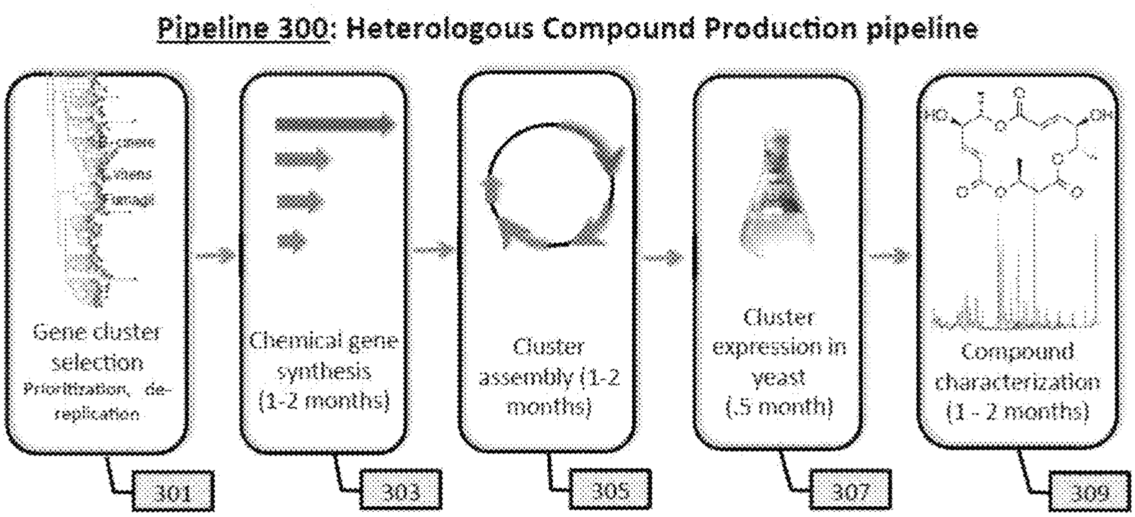
FIG. 5C illustrates an example production pipeline for producing secondary metabolites from gene clusters.
Figure 5D:
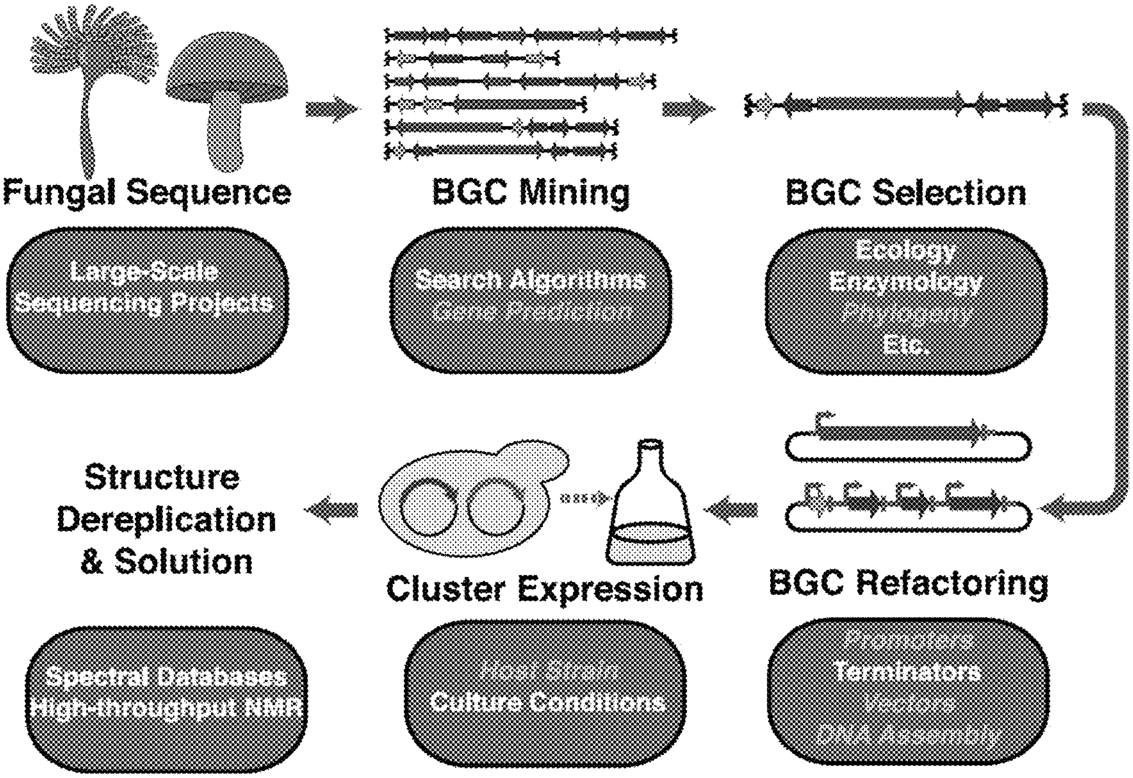
FIG. 5D illustrates an example work flow for producing secondary metabolites from gene clusters.

Illustrated in FIG. 5C is an exemplary pipeline to produce heterologous, biosynthetic compounds. Exemplary Pipeline 300 takes advantage of a yeast expression system to reproduce a fungal BGC in order to produce a heterologous compound product.

Pipeline 300 begins with selection of a biosynthetic gene cluster (301). Depicted, as an example, is a phylogenetic tree of numerous fungal BGCs. Using the phylogenetic data, a BGC having a desired trait is selected. The coding sequences of the various BGC genes are then used to chemically synthesize DNA molecules (303). The synthetized BGC DNA molecules are then to be assembled into a heterologous expression construct (305). In this example, the DNA molecules are assembled by yeast homologous recombination. Accordingly, the synthesized DNA molecules have overlapping homologous sequences that the yeast will use to recombine the various DNA molecules into a plasmid DNA vector.

Pipeline 300 then utilizes the assembled expression vectors to maintain and express the BGC in the yeast (307). The expression of the various heterologous genes results in expression of a number of heterologous enzymes that then can produce the heterologous biosynthetic compounds. Once a sufficient titer of compound is produced, it can be characterized to determine its structures and properties (309).

Briefly, the method comprises gene cluster selection as discussed herein, synthesis of coding sequence, promoters and terminators, assembly of the cluster coding sequence, expression in a fungal host, and isolation and characterization of compounds produced. An example of a gene cluster identified using the methods herein, and the compound created by expression of the identified genes in yeast, is shown in FIG. 15B.

Cluster Engineering

Once a gene cluster is identified according to the methods described herein, the cluster may be prepared for expression in a heterologous host cell. Editing of a putative gene cluster may involve steps such as: removal of introns, replacement of promoters, replacement of terminators, gene shuffling, and codon optimization. For example, if a gene cluster is to be expressed in *S. cerevisiae* then coding sequences from the gene cluster may be codon optimized for *S. cerevisiae*, and operably linked to *S. cerevisiae* promoters and terminators.

The gene cluster editing may rely on automatic annotation of expressed sequences, introns, and exons, or on manual inspection of the cluster. The gene cluster editing may be done in silico using the sequence data, or may be done in vitro or in vivo using the DNA sequence in a suitable vector such as a cloning vector. In some cases an initial edited gene cluster may not produce a product and reanalysis of the predicted coding sequences, and introns of the same, may reveal errors in the predicted transcription start sites, transcription termination sites and/or splice sites.

In an embodiment, this disclosure provides sequences (SEQ ID NOs: 67-483) of cryptic BGCs which encode various products. These BGCs may also be reengineered to provide the coding sequences without the endogenous regulatory sequences. The coding sequences from these clusters may be isolated and cloned into one or more expression vectors for expression in a model host system. The expression vectors may be plasmids, viruses, linear DNA, bacterial artificial chromosomes or yeast artificial chromosomes. The expression vectors may be designed to integrate into the host genome, or to not integrate. In some cases, the expression vector may be a high copy number plasmid.

Promoters

Expression of a refactored gene cluster in a host organism may require coordinated expression of several different coding sequences. In some cases, the expression of multiple different coding sequences in a host organism may require the use of multiple different promoters suitable for that organism. This disclosure provides methods for discovering multiple promoters with similar activities and expression patterns but with differing DNA sequence. Such methods may involve use of closely related species, such as different species of *Saccharomyces*. *Saccharomyces* (S.) is a genus of fungi composed of different yeast species. The genus can be divided into two further subgenera: *S.* sensu *stricto* and *S.* sensu *lato*. The former have relatively similar characteristics, including the ability to interbreed, exhibiting uniform karyotype of sixteen chromosomes, and their use in the fermentation industry. The later are more diverse and heterogeneous. Of particular importance is the *S. cerevisiae* species within the *S.* sensu *stricto* subgenus, which is a popular model organism used for genetic research.

The yeast *S. cerevisiae* is a powerful host for the heterologous expression of biosynthetic systems, including production of biofuels, commodity chemicals, and small molecule drugs. The yeast's genetic tractability, ease of culture at both small and large scale, and a suite of well-characterized genetic tools make it a desirable system for heterologous expression. Occasionally, production systems require coordinated expression of two or more heterologous genes. Coordinated expression systems in bacteria (e.g., *E. coli*) has long exploited the operon structure of bacterial gene clusters (e.g., lac operon), allowing a single promoter to control the expression of multiple genes.

The construction of synthetic operons therefore allows a single inducible promoter to control the timing and strength of expression of an entire synthetic system. In yeast, many heterologous-expression systems do not rely on the operon system, but instead rely on a one-promoter, one-gene paradigm. Accordingly, multi-gene heterologous expression is generally performed using multiple expression cassettes with a well-characterized promoter and terminator, each on a single expression vector (e.g., plasmid DNA) (See D. Mumberg, R. Muller, and M. Funk Gene 156:119-22, 1995). With traditional restriction-ligation cloning, it is also possible to recycle a promoter on a single plasmid by the serial cloning of multiple genes (M. C. Tang, et al., J Am Chem Soc 137:13724-27, 1995).

Turning now to the drawings and data, disclosed embodiments are generally directed to systems and constructs of heterologous expression during the production phase of yeast. In many of these embodiments, the expression system involves coordinated expression of multiple heterologous genes. More embodiments are directed to production-phase promoter systems having promoters that are inducible upon an event in the yeast's growth or by the nutrients and supplements provided to the yeast. Specifically, a number of embodiments are directed to the promoters that are capable of being repressed in the presence of glucose and/or dextrose. In more embodiments, the promoters are capable of being induced in the presence of glycerol and/or ethanol. In additional embodiments, at least one production-phase promoter exists within an exogenous DNA vector, such as (but not limited to), for example, a shuttle vector, cloning vector, and/or expression vector. Embodiments are also directed to the use of expression vectors for the expression of heterologous genes in a yeast expression system.

Controlled gene expression is desirable in heterologous expression systems. For example, it would be desirable to express heterologous genes for production during a longer stable phase. Accordingly, decoupling the anaerobic growth and aerobic production phases of a culture allows the yeast to grow to high density prior to introducing the metabolic stress of expressing unnaturally high amounts of heterologous protein. In accordance with many embodiments, the anaerobic growth phase is defined by the yeast culture's energy metabolism in which the yeast cells predominantly catabolize fermentable carbon sources (e.g., glucose and/or dextrose), and a high growth rate (i.e., short doubling-time). In contrast, and in accordance with several embodiments, the aerobic production phase is defined by the yeast culture's energy metabolism in which the yeast cells predominantly catabolize nonfermentable carbon sources (e.g., ethanol and/or glycerol), and a steady growth rate (i.e., long doubling-time). Accordingly, each yeast cell's energy metabolism can be predominantly in aerobic or nonaerobic phase, and dependent on the local concentration of the carbon source.

Figure 6A:
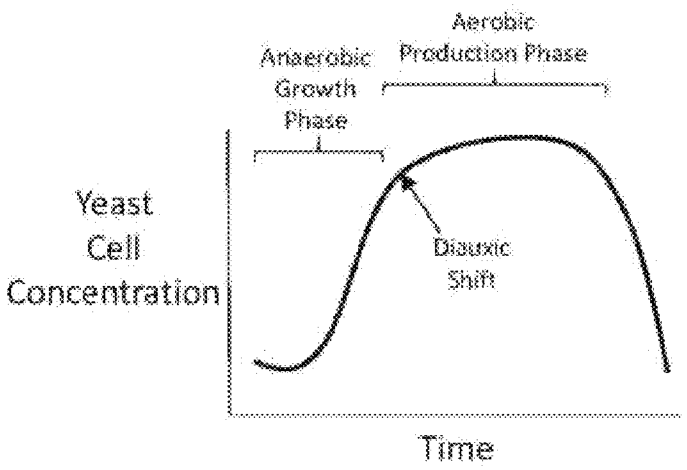
FIG. 6A illustrates a yeast phase chart displaying yeast cell concentration in relation to time to provide reference for various embodiments of the disclosure.

FIG. 6A depicts the phases of a yeast culture when provided a fermentable sugar, such as glucose or dextrose sugar, at a concentration of around 2-4% as its main carbon source. Initially, a yeast culture will predominantly catabolize the fermentable sugar, which correlates with an exponential growth with very high doubling rates. The growth phase typically lasts approximately 4-10 hours. During this phase, the catabolism of the fermentable sources results in the production of ethanol and glycerol.

Figure 6B:
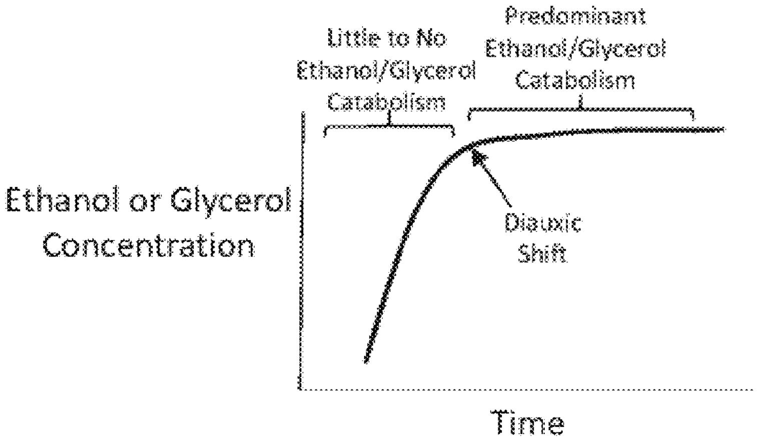
FIG. 6B illustrates a yeast phase chart displaying glucose or dextrose concentration in relation to time to provide reference for various embodiments of the disclosure.

Once glucose becomes scarce, the growth of a yeast culture passes a diauxic shift and begins to predominantly catabolize nonfermentable carbon sources (e.g., ethanol and/or glycerol) (FIG. 6B). The predominant catabolism of nonfermentable carbon source correlates with a longer and more stable production phase that can last for several days, or even weeks in an industrial-like setting (FIG. 6A). During the production phase, yeast cultures reach and maintain a high concentration, but have a much lower doubling time (FIG. 6A). Due to the decrease in doubling rate, yeast cultures no longer expend a great amount of energy and resources on rapid growth and thus can reallocate that energy and those resources to other biological activities, including heterologous expression. Accordingly, it is hypothesized that limiting the transcription of heterologous genes to the production phase would allow a yeast culture to reach a high, healthy confluency that would in turn allow better heterologous protein expression and biosynthetic production.

In yeast, transcriptional regulation can be achieved in several ways, including inducement by chemical substrates (e.g., copper or methionine), the tetON/OFF system, and promoters engineered to bind unnatural hybrid transcription factors. Perhaps the most commonly employed inducible promoters are the promoters controlled by the endogenous GAL4 transcription factor. GAL4 promoters are strongly repressed in glucose, and upon switching to galactose as a carbon source, strong induction of transcription is observed (M. Johnston and R. W. Davis, Mol. Cell Biol. 4:1440-48, 1984). While this system leads to high-level transcription, only four galactose-responsive promoters are known, and galactose is both a more expensive and a less efficient carbon source as compared to glucose (S. Ostergaard, et al., Biotechnol. Bioeng. 68:252-59, 2000). Other carbon-source dependent promoters have also been used for heterologous gene expression. The *S. cerevisiae* ADH2 gene exhibits significant derepression upon depletion of glucose as well as strong induction by either glycerol or ethanol (K. M. Lee & N. A. DeSilva Yeast. 22:431-40, 2005). Once induced, genes driven by the ADH2 promoter (pADH2) display expression levels equivalent to those driven by highly expressed constitutive counterparts. This induction profile was found to work in heterologous expression studies, as the system auto-induces upon glucose depletion in the late stages of fermentative growth after cells have undergone diauxic shift. The ADH2 promoter has been used extensively for yeast heterologous expression studies, resulting in high-level expression of several heterologous biosynthetic proteins (For example, see C. D. Reeves, et al., Appl. Environ. Microbiol. 74:5121-29, 2008).

Figure 6C:
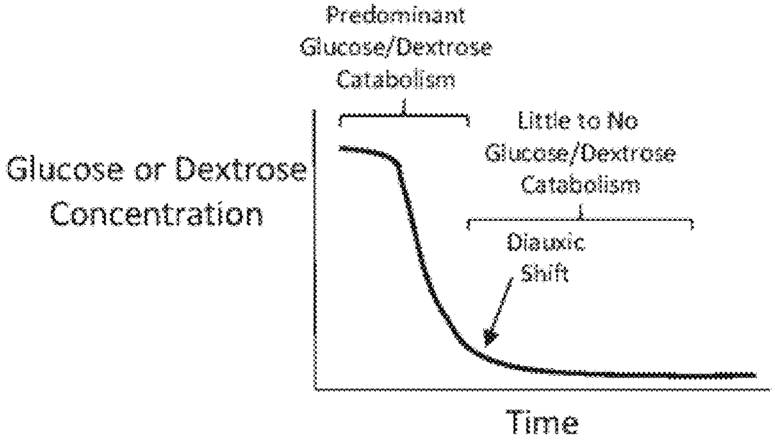
FIG. 6C illustrates a yeast phase chart displaying ethanol or glycerol concentration in relation to time to provide reference for various embodiments of the disclosure.

As shown in FIG. 6C, the concentration of ethanol and glycerol increases as glucose and dextrose sugar decreases, due to anaerobic glycolysis (i.e., breaking down the fermentable sugar) and subsequent fermentation (i.e., converting the broken-down glucose into alcohol) and glycerol biosynthesis (i.e., converting the broken-down glucose into glycerol). Upon fermentable sugar depletion, yeast cultures undergo a diauxic shift and begin to use ethanol and glycerol as a carbon source instead of glucose. A diauxic shift, as understood in the art, is defined as a point in time when an organism switches from primarily consumption of one source for energy, to primarily another source. This shift typically elicits significant changes to a yeast culture's gene-expression pattern. Accordingly, it is hypothesized that higher concentrations of ethanol, (e.g., ~2-4%) and or glycerol (e.g., ~2%) could be used to stimulate promoters that either directly or indirectly respond to these concentrations (See FIGS. 6A and 6C).

Various disclosed embodiments are based on the discovery of inducible promoters that can be used for the coordinated expression of multiple genes (e.g., gene cluster pathway) in *Saccharomyces* yeast. Described below are sets of inducible promoters from *S. cerevisiae* and related species that are inactive during anaerobic growth, activating transcription only after a diauxic shift when glucose is near-depleted and the yeast cells are respiring (i.e., the production phase). As portrayed in various embodiments, various production-phase promoters are auto-inducing and allow automatic decoupling of the growth and production phases of a culture and thus initiate heterologous expression without the need for exogenous inducers. It should be noted, however, that many embodiments include production-phase promoters that are also inducible in the presence of nonfermentable carbon-sources (e.g., ethanol and/or glycerol) supplied to the yeast. As such, multiple embodiments employ recombinant production-phase promoters that act much like constitutive promoters when the host yeast cultures are constantly maintained in ethanol and/or glycerol-containing media.

Once activated, the strength of various production-phase promoters can vary as much as 50-fold. The strongest production-phase promoters stimulate heterologous expression greater than that observed from strong constitutive promoters. The production-phase promoters could be employed in many different applications in which high expression of multiple genes is beneficial. Accordingly, the promoters can be used, for example, in multiple subunit protein production or for the production of biosynthetic compounds that are produced by multiple proteins within a pathway. Discussed in an exemplary embodiment below, some embodiments are used to express multiple proteins involved in production of indole diterpene compound product. When compared to constitutive promoters, the production-phase promoters produced greater than a 2-fold increase in titer of the exemplary diterpene compounds. In other exemplary embodiments, it was found that the production-phase promoter system outperformed constitutive promoters by over 80-fold. Thus, these promoters can enable heterologous expression of biosynthetic systems in yeast.

The practice of several embodiments will employ, unless otherwise indicated, conventional methods of chemistry, biochemistry, and molecular biology and recombinant DNA techniques within the skill of the art. Such techniques are explained fully in the literature. See, e.g., A. L. Lehninger, Biochemistry (Worth Publishers, Inc., 30 current addition); Sambrook, et al., Molecular Cloning: A Laboratory Manual (3rd Edition, 2001); Methods In Enzymology (S. Colowick and N. Kaplan eds., Academic Press, Inc.).

Inducible Production-Phase Promoters for Heterologous Expression in Yeast

In accordance with several embodiments, inducible production-phase promoters can be constructed into exogenous expression vectors for production of at least one protein in *Saccharomyces* yeast. In many embodiments, the constructed expression vectors have multiple inducible production-phase promoters in order to express multiple heterologous genes. Several embodiments are directed to production-phase promoters and DNA vectors incorporating these promoters. Promoters, in general, are defined as a noncoding portion of DNA sequence situated proximately upstream of a gene to regulate and promote its expression. Typically, in *S. cerevisiae* and similar species, the promoter of a gene can be found within 500-bp upstream of a gene's translation start codon. In some cases, a promoter may be about 500 bp, 600 bp, 700 bp, 800 bp, 900 bp, 1 kb, 1.5 kb, 2 kb or more than 2 kb upstream of a gene's transcription start site.

In accordance with several embodiments, production-phase promoters have two defining characteristics. First, production-phase promoters are capable of repressing heterologous expression of a gene in *S. cerevisiae* and similar species when the yeast is exhibiting anaerobic energy metabolism. As described previously, yeast exhibit anaerobic metabolism in the presence of a nontrivial concentration of fermentable carbon sources such as, for example, glucose or dextrose. In addition, production-phase promoters are also capable of inducing heterologous expression of a gene in *S. cerevisiae* and similar species when the yeast is exhibiting aerobic energy metabolism. As described previously, yeast exhibit aerobic metabolism when fermentable carbon sources are near depleted and the yeast cells switch to a catabolism of nonfermentable carbon sources such as glycerol or ethanol. These characteristics correspond to the phase charts in FIGS. 6A-6C. Tables 1 and 2 provide several examples of production-phase promoters in accordance with several embodiments.

The production-phase promoters can be characterized based on their level of transgene expression relative to each other and to constitutive promoters. As described in an exemplary embodiment below, it was found that the sequence of endogenous promoters of the *S. cerevisiae* genes ADH2, PCK1, MLS1, and ICL1 exhibited high-level expression and thus can be characterized as strong production-phase promoters (Table 1). Sequences of the endogenous promoters of the *S. cerevisiae* genes YLR307C-A, ORF-YGR067C IDP2, ADY2, CACI, ECM13, and FAT3 exhibited mid-level expression and thus can be characterized as semi-strong production phase promoters (Table 1). In addition, sequences of the endogenous promoters of the *S. cerevisiae* genes PUT1, NQM1, SFC1, JEN1, SIP18, ATO2, YIG1, and FBP1 exhibited low-level expression and thus can be characterized as weak production-phase promoters (Table 1).

TABLE 1

| Production-Phase Promoters Expression Phenotype | | | |
|---|---|---|---|
| Gene Name | Systematic Name | Expression Phenotype | Sequence ID Number |
| ADH2 | YMR303C | Strong | 1 |
| PCK1 | YKR097W | Strong | 2 |
| MLS1 | YNL117W | Strong | 3 |
| ICL1 | YER065C | Strong | 4 |
| YLR307C-A | YLR307C-A | Semi-Strong | 5 |
| YGR067C | YGR067C | Semi-Strong | 6 |
| IDP2 | YLR174W | Semi-Strong | 7 |
| ADY2 | YCR010C | Semi-Strong | 8 |
| GAC1 | YOR178C | Semi-Strong | 9 |
| ECM13 | YBL043W | Semi-Strong | 10 |
| FAT3 | YKL187C | Semi-Strong | 11 |
| PUT1 | YLR142W | Weak | 12 |
| NQM1 | YGRO43C | Weak | 13 |
| SFC1 | YJR095W | Weak | 14 |
| JEN1 | YKL217W | Weak | 15 |
| SIP18 | YMR175W | Weak | 16 |
| ATO2 | YNR002C | Weak | 17 |
| YIG1 | YPL201C | Weak | 18 |
| FBP1 | YLR377C | Weak | 19 |

The closely related *S.* sensu *stricto* species have similar genetics and growth characteristics. Accordingly, the phase charts provided in FIGS. 6A-6C apply generally to *S.* sensu *stricto* species. Table 2 provides a list of strong production-phase exogenous promoters of similarly related species in accordance with numerous embodiments of the disclosure.

TABLE 2

| Strong Production-Phase Promoters of *S. sensu stricto* species | | |
|---|---|---|
| Species | Gene Name | Sequence ID Number |
| *S. paradoxus* | ADH2 | 36 |
| *S. kudriavzevii* | ADH2 | 37 |
| *S. bayanus* | ADH2 | 38 |
| *S. paradoxus* | PCK1 | 41 |
| *S. kudriavzevii* | PCK1 | 42 |
| *S. bayanus* | PCK1 | 43 |
| *S. paradoxus* | MLS1 | 44 |
| *S. kudriavzevii* | MLS1 | 45 |
| *S. bayanus* | MLS1 | 46 |
| *S. paradoxus* | ICL1 | 47 |
| *S. kudriavzevii* | ICL1 | 48 |
| *S. bayanus* | ICL1 | 49 |

It should be noted that substantially similar sequences to the production-promoter sequences are expected to regulate heterologous expression in *S. cerevisiae* and achieve similar results. Accordingly, a substantially similar sequence of a production-phase promoter, in accordance with numerous embodiments, is any sequence with a high functional equivalence such that when regulating heterologous expression in *S. cerevisiae* that it achieves substantially similar results. For example, in an exemplary embodiment below, it was found that the ADH2 promoter of *S. bayanus* is only 61% homologous, yet achieved strong heterologous expression in *S. cerevisiae*, similar to the endogenous ADH2 promoter. In some cases, a substantially similar sequence may be homologous to the promoter sequences identified herein (e.g., have a nucleotide BLAST e value of less than or equal to $10^{-10}$, $10^{-20}$, $10^{-30}$, $10^{-35}$ or $10^{-40}$).

Figure 7A:
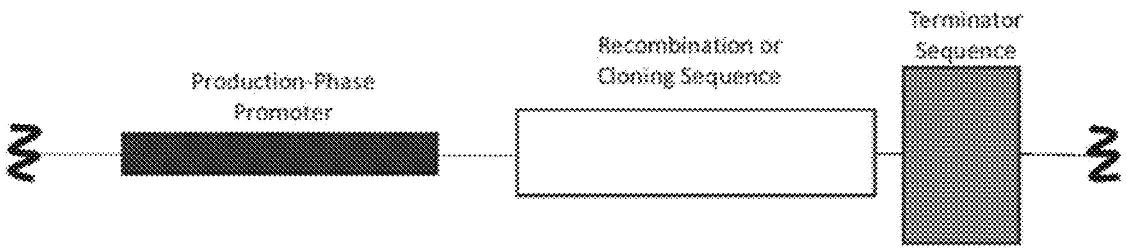
FIG. 7A illustrates a DNA vector having a production-phase promoter in accordance with an embodiment of the disclosure.

In FIG. 7A, an exemplary schematic of a section of an exogenous DNA vector (e.g., cloning vector, expression vector, and/or shuttle vector) having a production-phase promoter sequence embedded within. A vector is capable of transferring nucleic acid sequences to target cells (e.g., yeast). Typical DNA vectors include, but are not limited to, plasmid or viral constructs. DNA vectors are also meant to include a kit of various linear DNA fragments that are to be recombined to form a plasmid or other functional construct, as is common in yeast homologous recombination methods (See e.g., Z. Shao, H. Zhao & H. Zhao, 2009, Nucleic Acids Research 37:e16, 2009, the disclosure of which is incorporated herein by reference). Often, embodiments of cloning vectors will incorporate other sequences in addition to the production-phase promoter. As depicted in FIG. 7A, the exemplary cloning vector has a terminator sequence and cloning/recombination sequence in addition to the production-phase promoter, each of which can assist with expression vector construction. Furthermore, other sequences necessary for growth and amplification can be incorporated into the promoter vector. Embodiments of these sequences may include, for example, at least one appropriate origin of replication, at least one selectable marker, and/or at least one auxotrophic marker. It should be noted, however, that various embodiments of the disclosure are not required to contain cloning, terminator, or either sequences. For example, embodiments of a typical shuttle vector may only contain the production-phase promoter sequence along with the necessary sequences for amplification in a biological system.

For purposes of this application, an exogenous DNA vector is any DNA vector that was constructed, at least in part, exogenously. Accordingly, DNA vectors that are assembled using the yeast's own cell machinery (e.g., yeast homologous recombination) would still be considered exogenous if any of the DNA molecules transduced within yeast for recombination contain exogenous sequence or were produced by a non-host methodology, such as, for example, chemical synthesis, PCR amplification, or bacterial amplification.

Figure 7B:
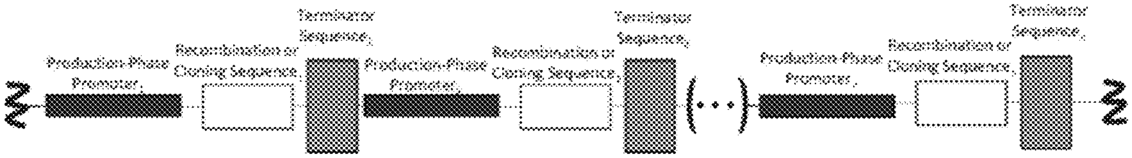
FIG. 7B illustrates a DNA vector having multiple production-phase promoters in accordance with an embodiment of the disclosure.

As shown in FIG. 7B, various embodiments of the disclosure are directed to DNA vectors having multiple production-phase promoters. In these various embodiments, multiple different production-phase promoters are incorporated, preferably each having a unique sequence and derived from a different gene and/or *S.* sensu *stricto* species. Having unique promoter sequences can prevent complications that can arise during product production in yeast, such as, for example, unwanted DNA recombination at sites similar to the promoter sequences that render the DNA vector constructs undesirable. In many embodiments, the DNA vector has at least 2, 3, 4, 5, 6, 7, 8, 9, 10, 11, 12, 13, 14, 15, 16, 17, 18, 19, 20 or more than 20 production-phase promoters. As the size of the DNA vector increases, the utility may decrease, as larger vectors may become unwieldly for the intended organism to handle. For example, plasmids for amplification in *E. coli* are often somewhere between 2,000 and 10,000 base pairs (bp) but can handle up to 20,000 bp or so. Likewise, plasmids for amplification and growth in yeast can vary from approximately 10,000 to 30,000 bp. Viral vectors, on the other hand, often have a limited construct size and thus may require a more precise vector size. Thus, depending on vector and intended use, the number of production-phase promoters within a DNA vector will vary.

Although FIG. 7B depicts recombination sites, cloning sites, and terminator sequences, it should be noted that these sequences may or may not be included in various embodiments of DNA vectors having multiple production-phase promoters. The incorporation of these sequences or other various sequences is often dependent on the purpose of the DNA vector. For example, cloning vectors may not include a terminator sequence if that sequence is to be incorporated into an expression construct at another stage of assembly.

Figure 8A:
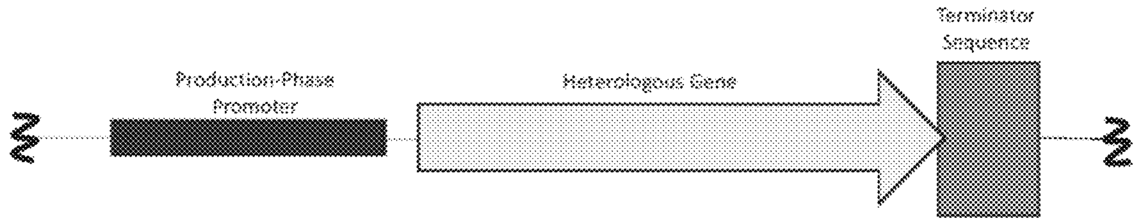
FIG. 8A illustrates a DNA expression vector having a production-phase promoter within an expression cassette in accordance with an embodiment of the disclosure.

FIG. 8A depicts an exemplary heterologous expression vector having a production-phase promoter for expression in yeast, in accordance with various embodiments of the disclosure. Expression constructs contain an expression cassette that has a promoter, a heterologous gene, and a terminator sequence in order to produce an RNA molecule in an appropriate host. Expression cassette in accordance with numerous embodiments will have a production-phase promoter situated proximately upstream of a heterologous gene of which the promoter is to regulate expression. It should be understood, that the precise location of the production-phase promoter upstream of the heterologous gene may vary, but the promoter generally is within a certain proximity to adequately function.

In many embodiments of the disclosure, a heterologous gene is any gene driven by a production-phase promoter, wherein the heterologous gene is different than the endogenous gene that the promoter regulates within its endogenous genome. Accordingly, a *S. cerevisiae* production-phase promoter could regulate another *S. cerevisiae* gene provided that the gene to be regulated is not the gene endogenously regulated. For example, the *S. cerevisiae* ADH2 promoter should not regulate the *S. cerevisiae* ADH2 gene; however, the *S. cerevisiae* ADH2 promoter can regulate any other *S. cerevisiae* gene or the ADH2 gene from any other species. Often, in accordance with many embodiments, the heterologous gene is from a different species than the species from which the production-promoter sequence was obtained.

Although not depicted, various embodiments of expression cassettes may include other sequences, such as, for example, intron sequences, Kozak-like sequences, and/or protein tag sequences (e.g., 6×-His) that may or may not improve expression, production, and/or purification. In yeast, various embodiments of expression vectors will also minimally have a yeast origin of replication (e.g., 2-micron) and an auxotrophic marker (e.g., URA3) in addition to the expression cassette. Other nonessential sequences may also be included, such as, for example, bacterial origins of replication and/or bacterial selection markers that would render the expression capable of amplification in a bacterial host in addition to a yeast host. Accordingly, various embodiments of expression vectors would include the essential sequences for heterologous expression in yeast and other various embodiments would include additional nonessential sequences.

Figure 8B:
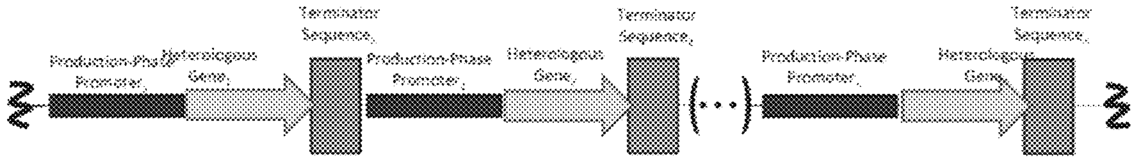
FIG. 8B illustrates a DNA expression vector having multiple production-phase promoters, each within an expression cassette in accordance with an embodiment of the disclosure.

In accordance with various embodiments, a DNA vector having a production-phase promoter expression cassette can be transformed into a yeast cell. Or alternatively, and in accordance with numerous embodiments, a DNA vector having a production-phase promoter expression cassette can be assembled within yeast using homologous recombination techniques. Once existing within a yeast cell, the production-phase promoter can regulate the expression of a heterologous gene in accordance with the yeast cell's energy metabolism. As described previously, and in accordance with many embodiments, production-phase promoters repress heterologous expression when the yeast cell is in an anaerobic energy metabolic state. Alternatively, and in accordance with a number of embodiments, production-phase promoters induce heterologous expression when the yeast cell is in an aerobic energy metabolic state Depicted in FIG. 8B are alternative exemplary heterologous expression vectors having multiple production-phase promoters for expression of multiple genes in yeast in accordance with numerous embodiments. In some embodiments, the expression vectors will include at least two expression cassettes, each with a unique promoter, gene, and terminator sequence in order to prevent unwanted recombination. The number of expression cassettes will vary based on vector construct design and application. For heterologous expression in *S. cerevisiae*, it has been found that plasmid expression vectors of approximately 30,000 bp are still tolerated. Thus, vectors containing up to seven production-phase promoter expression cassettes can be incorporated into an expression vector and have been found to be able to maintain adequate gene expression and protein production. Larger vectors with more expression cassettes may be tolerated.

Although FIG. 8B depicts multiple expression cassettes sequentially in the same orientation (5' to 3'), it should be understood that the combination of two or more expression cassettes is not limited to sequential linear organization in the same orientation. Expression cassettes in accordance with many embodiments exist within the expression vector in any orientation and in any sequential order. Furthermore, it should be understood that other sequence elements of an expression vector (e.g., an auxotrophic marker) may be among and/or between the multiple expression cassettes. Optimal vector design is likely to depend on various factors, such as, for example, optimizing the location of the auxotrophic marker to enable the final expression vector to include each expression cassette to be incorporated.

DNA heterologous expression vectors are a class of DNA vectors, and thus the description of general DNA vectors above also applies to the expression vectors. Accordingly, many embodiments of the expression vectors are formulated into a plasmid vector, a viral vector, a circular vector, or a kit of linear DNA fragments to be recombined into a plasmid by yeast homologous recombination. In several of these embodiments, the end-product vector contains at least one expression cassette having a production-phase promoter. It should be understood, that in addition to the at least one production-phase promoter, some vector embodiments incorporate expression cassettes that include other promoters, such as (but not limited to), constitutive promoters that maintain high expression during the growth and production phases.

The various embodiments of heterologous expression vectors having at least one production-phase promoter can be used in numerous applications. For example, high expression in the production phase can lead to better, prolonged expression, as compared to constitutive promoters. In many applications, the end product is a protein from a single gene or a protein complex of multiple genes to be purified from the culture. For these applications, high, prolonged expression using production-phase promoters can lead to better yields of proteins. Furthermore, when the heterologous protein is toxic to the host yeast cells, the use of production-phase promoters prevents the expression of the toxic protein during growth phase, allowing the yeast to reach a healthy confluency before mass protein production.

The production-phase promoter vectors can also benefit the production of a biosynthetic compound from a gene cluster. Many products derived from various natural species are produced from a cluster of genes with sequential enzymatic activity. For example, the antibiotic emindole SB is produced from a cluster of four genes that is expressed in *Aspergillus tubingensis*. To reproduce this gene cluster in a yeast production model, a production-promoter vector system with four different expression cassettes could work. This system would allow the yeast to reach a healthy confluency before the energy-draining expression of four heterologous proteins begins, leading to better overall yields of the antibiotic product. In fact, experimental results provided in an exemplary embodiment described in Example 1 below demonstrate that a production-phase promoter vector outperformed a constitutive promoter vector approximately 2-fold to produce the emindole SB product.

Figure 9:
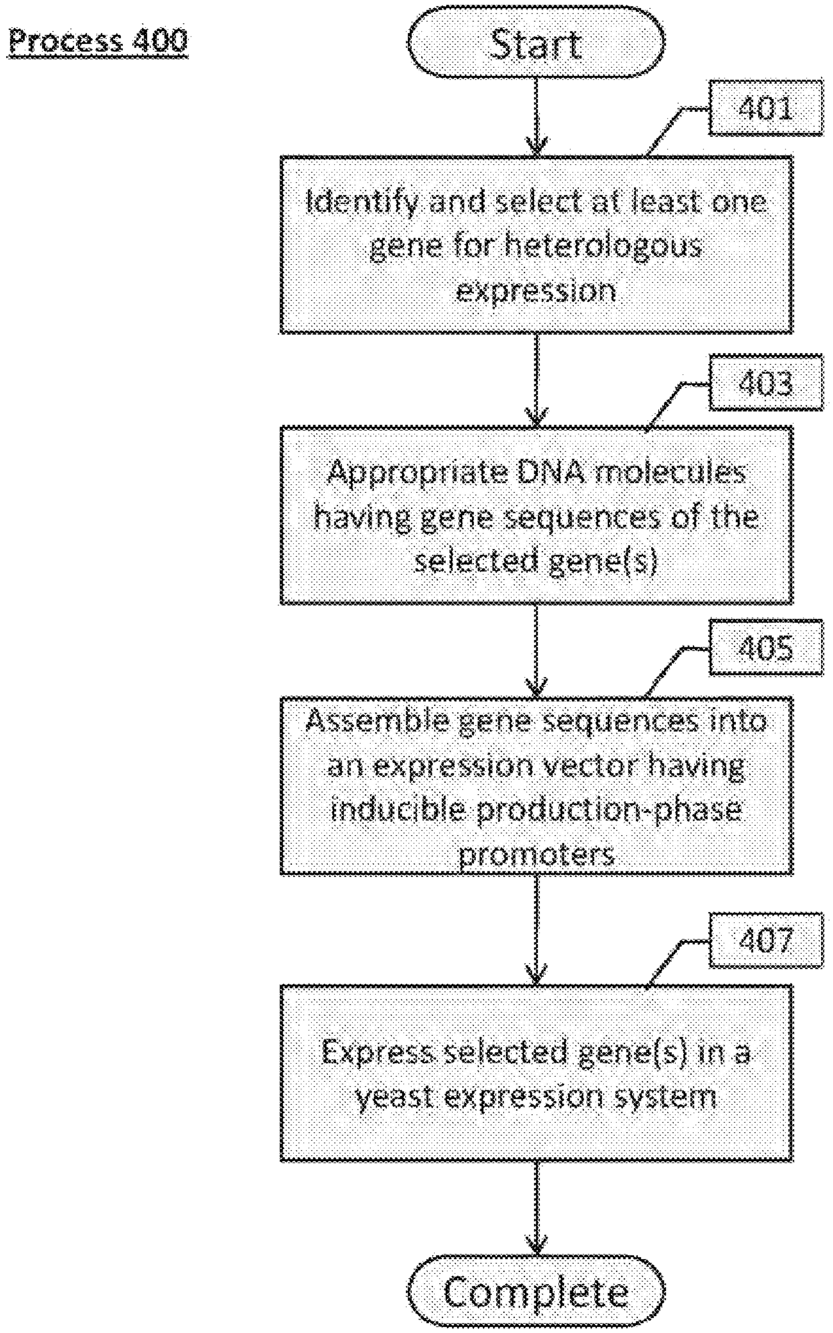
FIG. 9 illustrates a method to construct and utilize production-phase promoter DNA vectors in accordance with various embodiments of the disclosure.

FIG. 9 depicts an exemplary process (Process 400) to implement various embodiments of production-phase promoters. To begin, Process 400 identifies and selects at least one gene for heterologous expression in yeast (401). The choice of gene(s) for expression would depend on the desired outcome. For example, to produce a biosynthetic compound, one would likely select to express all, or a subset, of the genes within a biosynthetic gene cluster of a particular organism. Once the gene(s) have been selected, Process 400 then appropriates DNA molecules having the coding sequence of the selected genes (403). As is well known in the art, there are many ways to appropriate DNA molecules, which include chemical synthesis, extraction directly from the biological source, or amplification of a gene by polymerase chain reaction (PCR).

Process 400 then uses the appropriated DNA molecules to assemble these molecules into an expression vector having production-phase promoters (405). There are many ways to assemble DNA expression vectors that are well known in the art, which include popular methodologies such as homologous recombination and restriction digestion with subsequent ligation. After assembly, the resultant expression vectors can be expressed in *Saccharomyces* yeast to obtain the desired outcome (407).

Yeast Homologous Recombination for Plasmid Construction and Direct Plasmid Sequencing Each of the one or more expression vectors may contain one or more promoters suitable for expression of a heterologous gene in a model host system. Each expression vector may contain a single coding sequence or multiple coding sequences. Multiple coding sequences may be functionally linked to a single promoter, for example via an internal ribosome entry site, or may be linked to multiple promoters. The expression vectors may also contain additional elements to regulate or increase the transcriptional activity, for example enhancers, polyA sequences, introns, and posttranscriptional stability elements. The expression vectors may also contain one or more selectable markers.

Figure 10A:
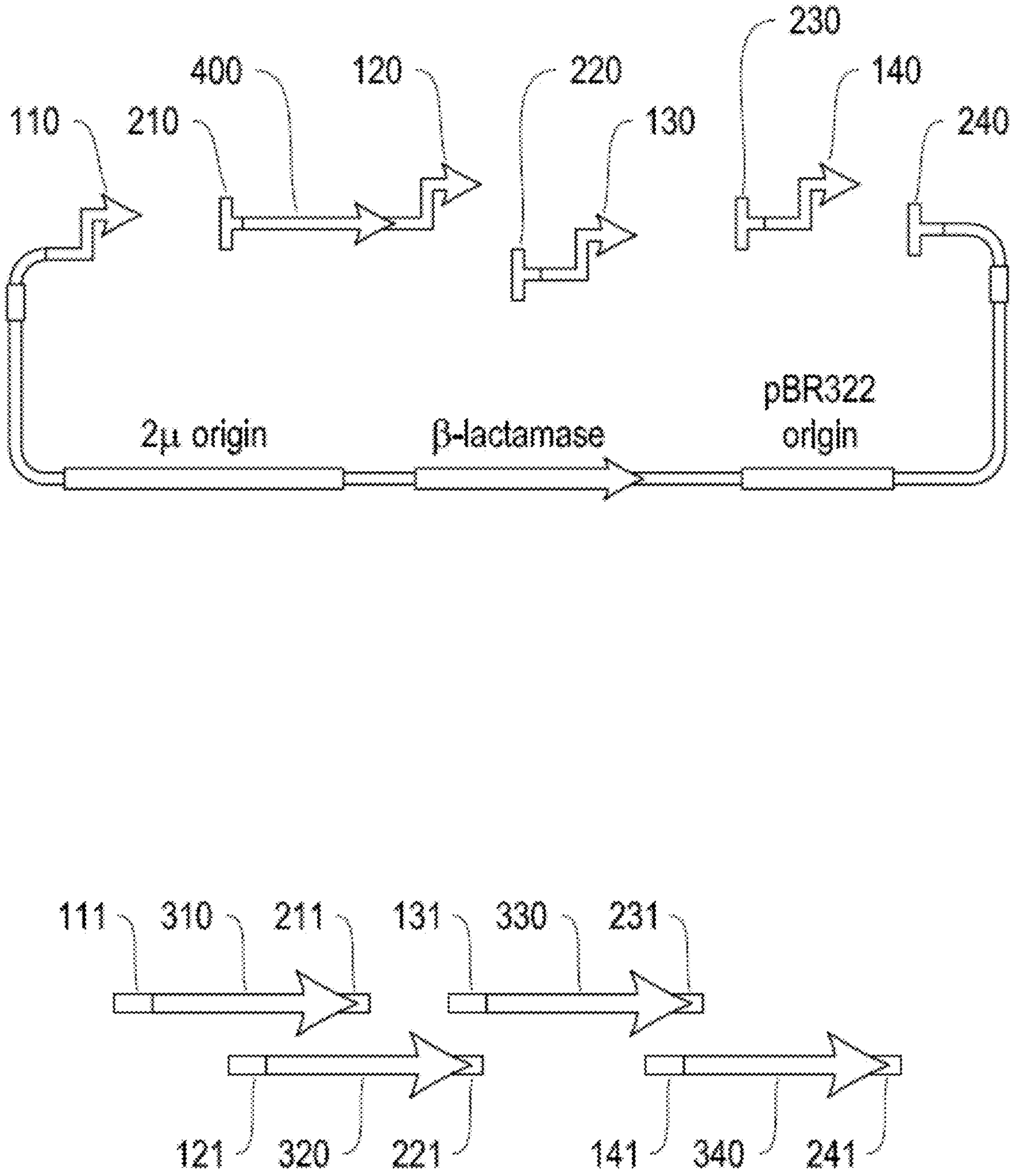
FIG. 10A illustrates an overview of an approach involving yeast homologous recombination assembly.

To improve high-throughput assembly and characterization of orphan biosynthetic systems or other systems, an automated DNA assembly pipeline using yeast homologous recombination, (YHR), as its core technology was developed. An example of the design strategy for assembling DNA parts for this pipeline is illustrated in FIG. 10A. In one embodiment a method is provided for assembling synthetic gene clusters with heterologous regulation. DNA polynucleotides coding for a series of distinct promoters and terminators may be obtained in bulk and used for a variety of different synthetic gene clusters. Once a gene cluster of interest is identified the coding sequences are determined and then all coding sequences are synthesized with a flanking sequence (assembly overhang) on each side. The assembly overhangs, encode either for the flanking promoter and terminator if the gene is small enough to be ordered as a single piece, or for the adjacent gene fragments for longer sequences. The length of the flanking sequences may vary, In some cases, the flanking sequences may be about 30 bp, 40 bp, 50 bp, 60 bp, 70 bp, 80 bp, 90 bp, 100 bp, 30-100 bp, 30-70 bp, 40-60 bp, 40-80 bp, or 45-55 bp in length. Placing assembly overhangs exclusively on the unique coding sequence fragments allows for all regulatory cassettes to be generated in bulk and stockpiled as the same fragments are used in all assemblies. For example, in an assembly involving three or more genes, an auxotrophic marker may be placed between the second terminator and third terminator while no marker is present on the vector. By providing the auxotrophic marker and origin of replication on separate fragments, reaction background was significantly reduced. Additional modest increases in efficiency were observed when the assembly host is lacking a DNA ligase, such as the DNL4 DNA ligase.

In some embodiments, this disclosure provides a system for generating a synthetic gene cluster via homologous recombination. The system comprises 1 though N unique promoter sequences, 1 through N unique terminator sequences, and 1 through N unique coding sequences. Each terminator sequence may be linked to the following promoter sequence, for example terminator 1 is linked to promoter 2, terminator 2 is linked to promoter 3, and so forth till terminator N−1 which is linked to promoter N. In some cases, promoter 1 and terminator N may be attached to a linear plasmid backbone. Coding sequence 1 is attached to an additional 30-70 base pair sequence on each end such that a first end portion is identical or homologous to the last 30-70 base pairs of promoter 1 and a second end portion is identical or homologous to the first 30-70 base pairs of terminator 1. Coding sequence 2 is attached to an additional 30-70 base pair sequence on each end such that a first end portion is identical or homologous to the last 30-70 base pairs of promoter 2 and a second end portion is identical or homologous to the first 30-70 base pairs of terminator 2. Coding sequence N is also attached to an additional 30-70 base pair sequence on each end such that a first end portion is identical or homologous to the last 30-70 base pairs of promoter N and a second end portion is identical or homologous to the first 30-70 base pairs of terminator N. These DNA fragments may be assembled transforming the 1 through N promoters, terminators and coding sequences into a yeast cell where they are combined through yeast homologous recombination, and then isolating a plasmid containing the 1 through N promoters, terminators and coding sequences from the yeast cell.

An example of this system is shown in FIG. 10A. In this example N equals four. The system comprises four unique promoters (110, 120, 130 and 140), four unique terminator sequences (210, 220, 230 and 240), and four unique coding sequences (310, 320, 330, and 340). Each of the coding sequences is created with an additional 30-70 base pair sequence that is homologous or identical to the sequence of the preceding promoter and an additional 30-70 base pair sequence that is homologous or identical to the sequence of the subsequent terminator. Thus, coding sequence 310 is flanked by sequence 111 which is identical or homologous to at least a part of sequence 110, and sequence 211 which is identical or homologous to an least a part of sequence 210. Coding sequence 320 is flanked by sequence 121 which is identical or homologous to at least a part of sequence 120, and sequence 221 which is identical or homologous to an least a part of sequence 220. Coding sequence 330 is flanked by sequence 131 which is identical or homologous to at least a part of sequence 130, and sequence 231 which is identical or homologous to an least a part of sequence 230. Coding sequence 340 is flanked by sequence 141 which is identical or homologous to at least a part of sequence 140, and sequence 241 which is identical or homologous to an least a part of sequence 240. In this example promoter sequence 110 and terminator sequence 240 are attached to the ends of a linearized plasmid backbone, and the DNA fragment comprising terminator 210 and promoter 120 further comprises an auxotrophic marker (400). Terminator 210 is linked to promoter 120, terminator 220 is linked to promoter 130, and terminator 230 is linked to promoter 140.

Figure 10B:
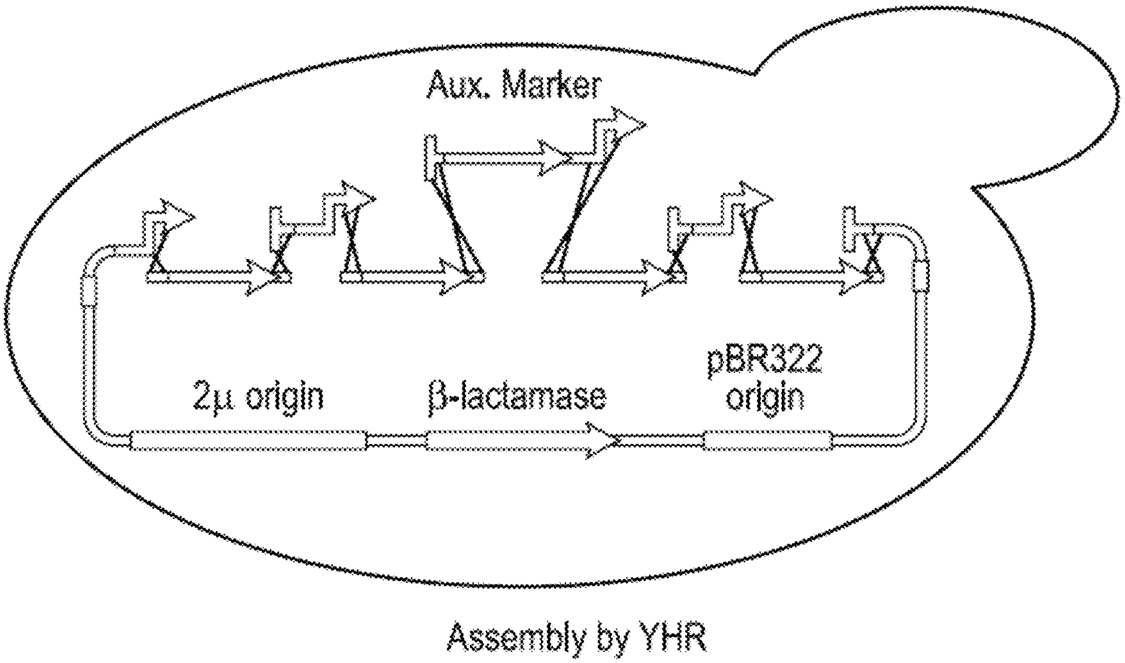
FIG. 10B illustrates the homologous recombination in yeast of the parts from FIG. 10A.
Figure 10C:
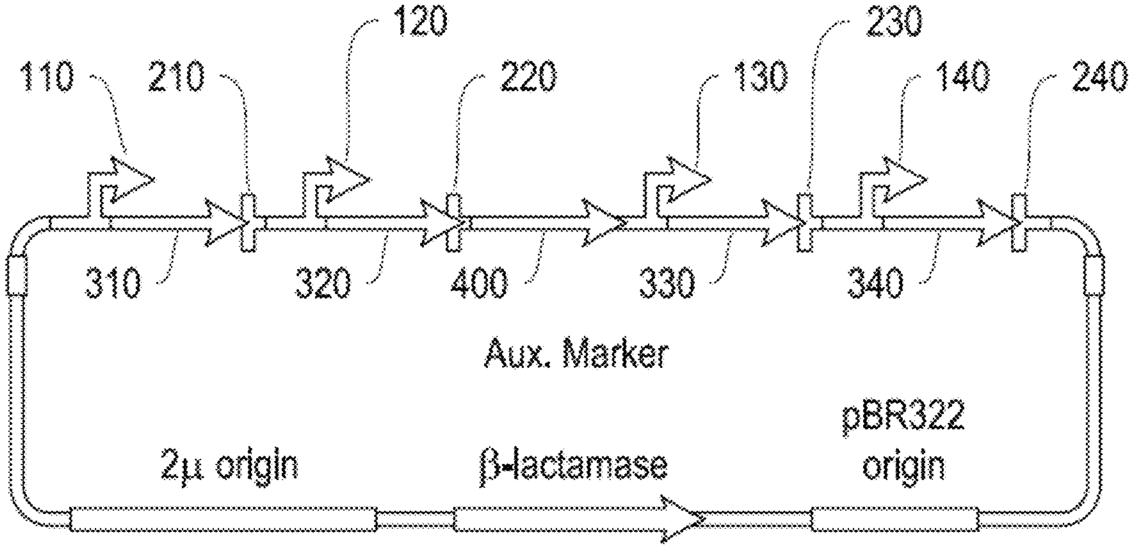
FIG. 10C illustrates the plasmid which results from the parts of FIG. 10A, homologously recombined as in FIG. 10B.

As shown in FIG. 10B, once the DNA sequences from FIG. 10A are transfected into a yeast cell the homologous sequences are paired up and the fragments are linked together through yeast homologous recombination. The resultant DNA plasmid is illustrated in FIG. 10C.

Figure 10D:
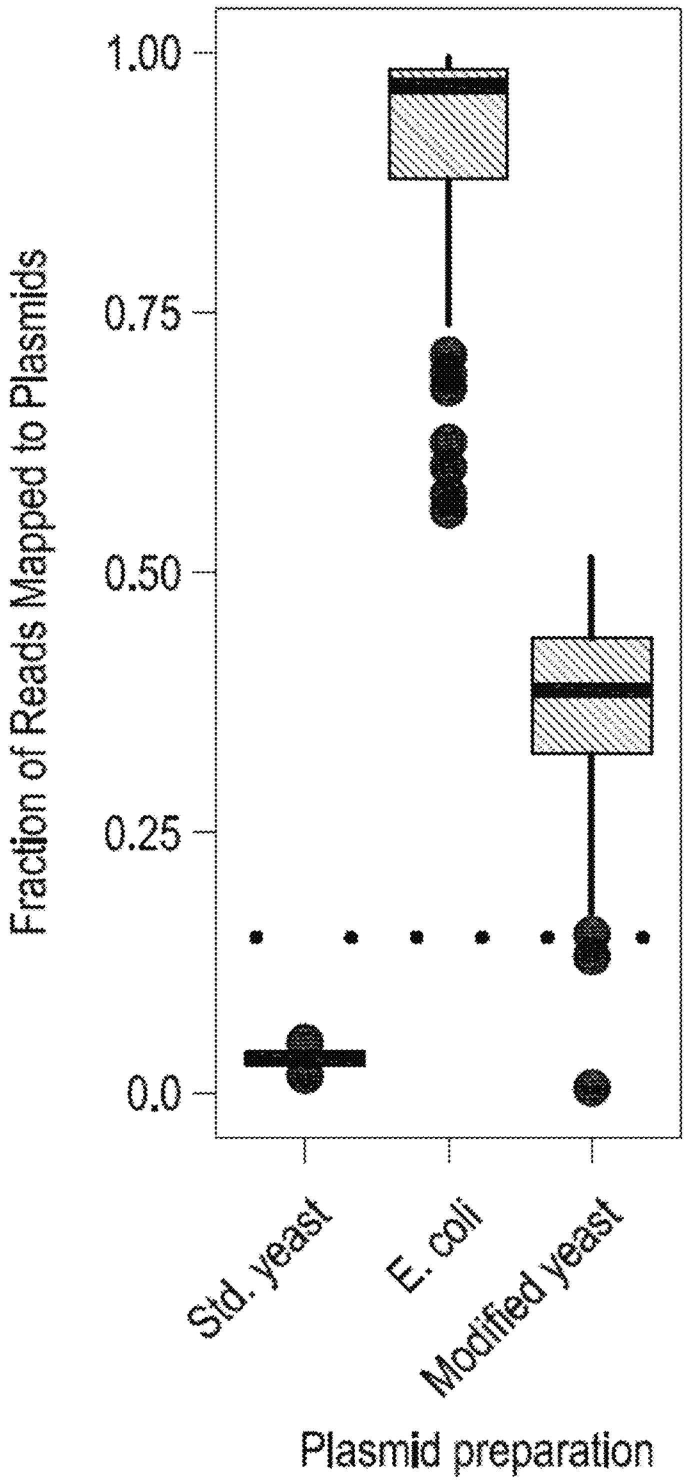
FIG. 10D illustrates improved sequencing results obtained via disclosed methods.
Figure 10E:
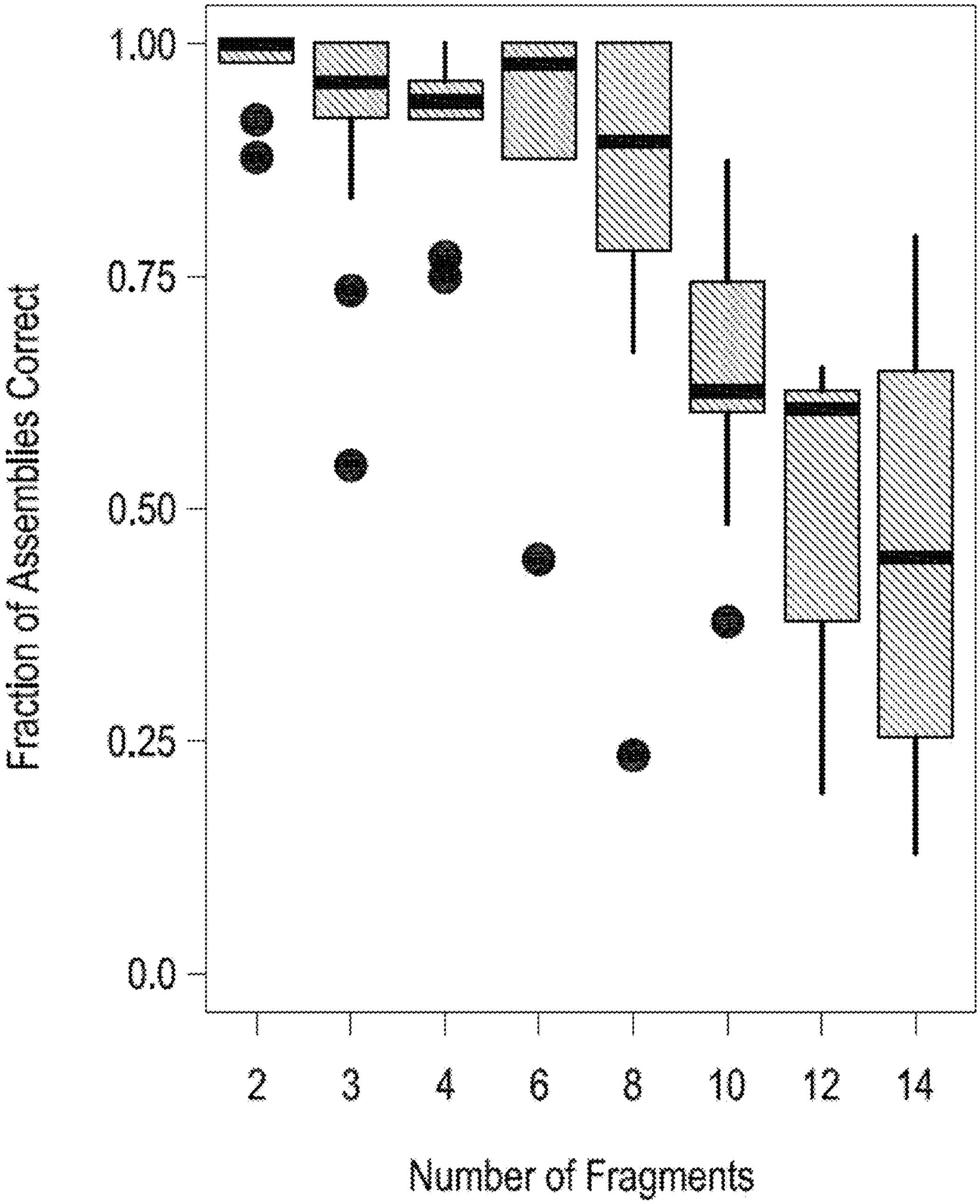
FIG. 10E illustrates assembly of plasmid DNA from up to 14 individual fragments.

Traditionally, for yeast homologous recombination plasmid assemblies, plasmid DNA is isolated from assembly clones and transformed into *E. coli* in order to obtain sufficiently pure DNA to enable sequencing. The necessity of this step arises from the relatively low plasmid yields from yeast and the large amounts of contaminating genomic DNA in every sample. This disclosure provides a method by which plasmid DNA may be sequenced directly out of yeast. This may be achieved by a modified plasmid prep in which the majority of contaminating DNA is removed by treatment with an exonuclease enzyme. Any enzyme with exonuclease activity and free of endonuclease activity may be used in this step. Examples of exonuclease enzymes include but are not limited to: Lambda Exonuclease, RecJf, Exonuclease III (*E. coli*), Exonuclease I (*E. coli*), Exonuclease T, Exonuclease V (RecBCD), Exonuclease VIII, truncated, Exonuclease VII, T5 Exonuclease, and T7 Exonuclease. In some cases, the exonuclease is Exonuclease V. If an exonuclease with activity for single stranded DNA (ssDNA) and not double stranded DNA (dsDNA) is to be used, then the DNA may first be heated to denature the dsDNA. In some cases, the DNA may be treated with a topoisomerase to relax supercoiled plasmids. In some cases, the DNA may not be treated with a topoisomerase. Once the plasmid DNA has been purified by this method sequencing libraries can be prepared. FIG. 10D demonstrates the increase in purity observed with the exonuclease treatment. Overall, this pipeline has been applied to the sequencing of >1000 clones. Assemblies of up to 10, 11, 12, 13, 14, 15, 16, 17, 18, 19, 20, 21, 22, 23, 24, 25, 26, 27, 28, 29, 30 or more than 30 unique DNA fragments can be achieved with high efficiency. FIG. 10E shows efficient assembly of 2, 3, 4, 5, 6, 8, 10, 12, and 14 DNA fragments. In some cases a strain as described herein allows DNA assembly via homologous recombination with an efficiency of at least 60%, 70%, 80%, 90%, 100%, 110%, 120%, 130%, 140%, 150%, or more than 150% as compared to DNA assembly in BY.

Figure 11A:
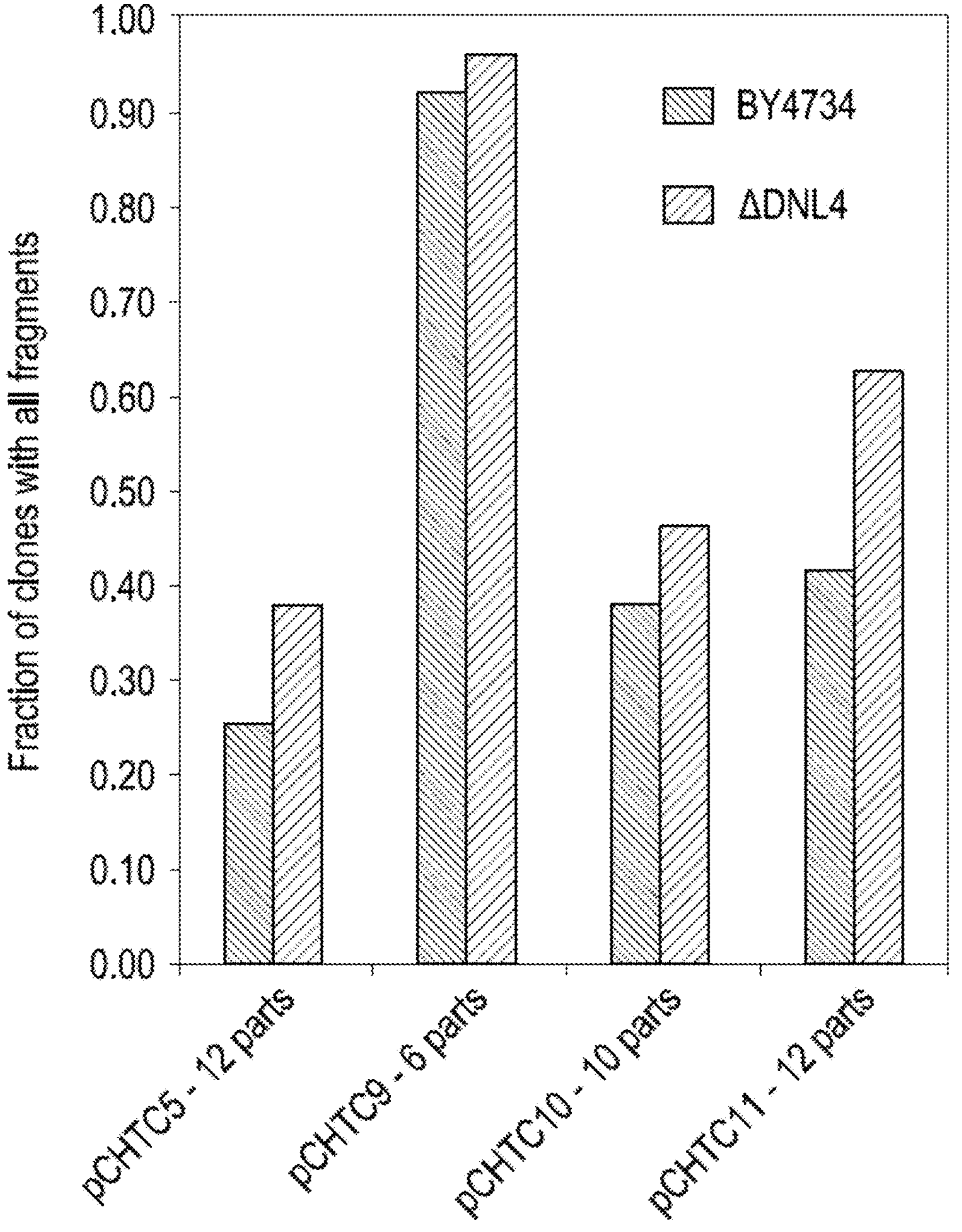
FIG. 11A illustrates improved assembly efficiency in a background lacking the DNL4 ligase.

To increase the efficiency of assemblies by yeast homologous repair, the relative efficiencies of BY4743 and BY4743ΔDNL4 were tested; a strain in which the DNL4 ligase, involved in non-homologous end joining, has been deleted. FIG. 11A illustrates efficiencies of several plasmid assemblies done in both strains, demonstrating the deletion of the DNL4 DNA ligase does consistently serve as the more efficient assembly background.

Figure 11B:
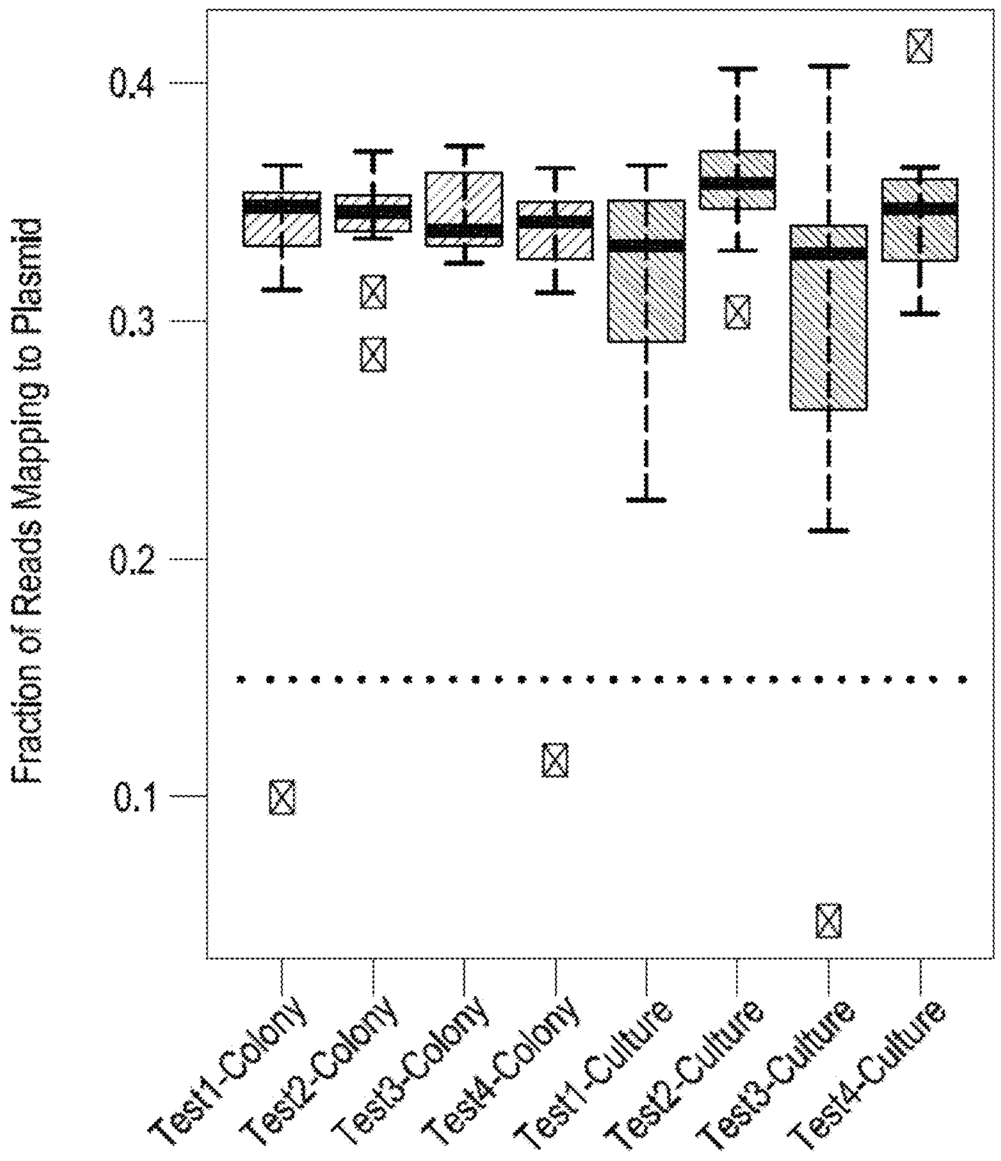
FIG. 11B illustrates equivalent sequencing efficiencies using DNA prepared from both colonies (red) and liquid cultures (blue) for four test assemblies.
Figure 11C:
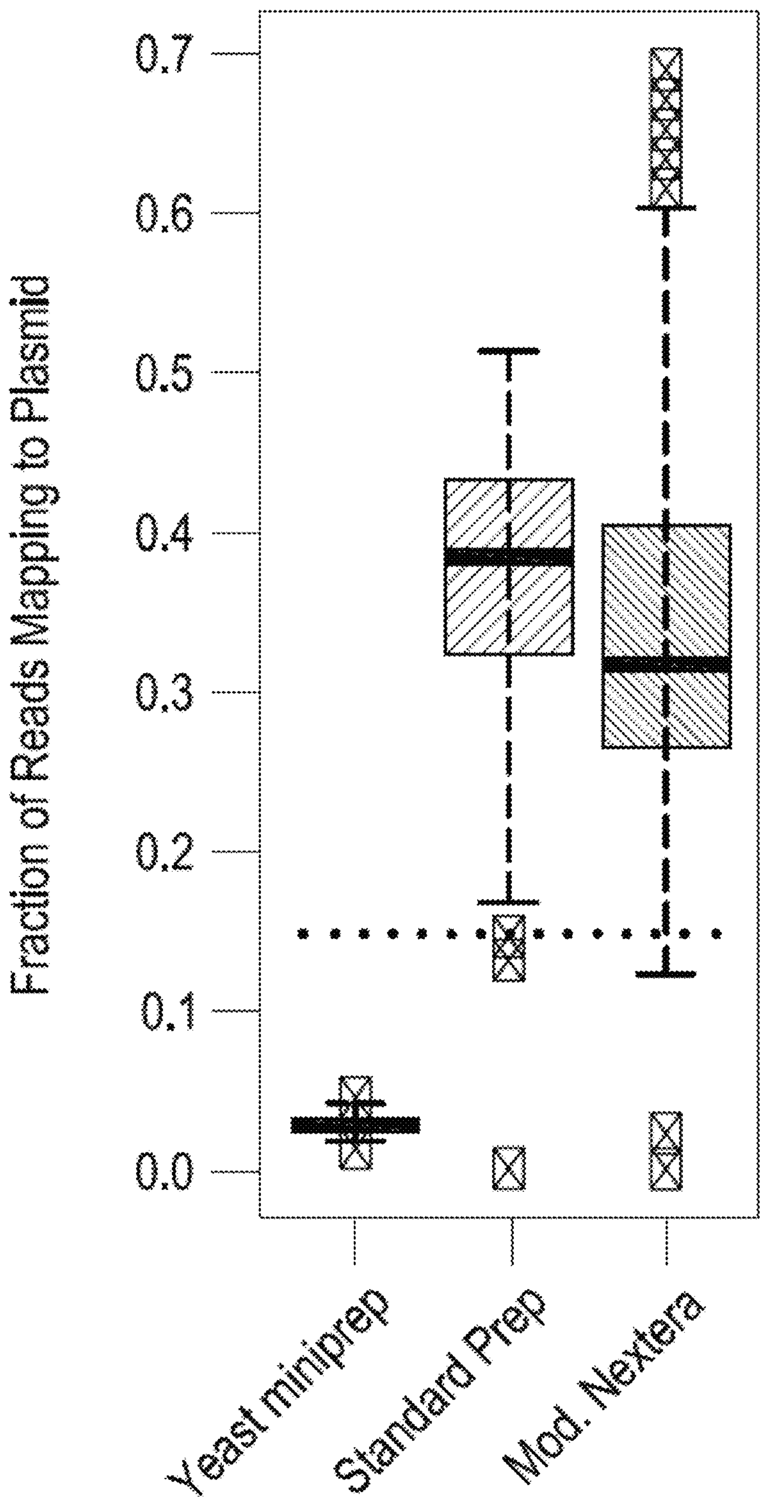
FIG. 11C illustrates sequencing efficiencies observed using both standard and modified NexteraXT library preparation methods.
Figure 11D:
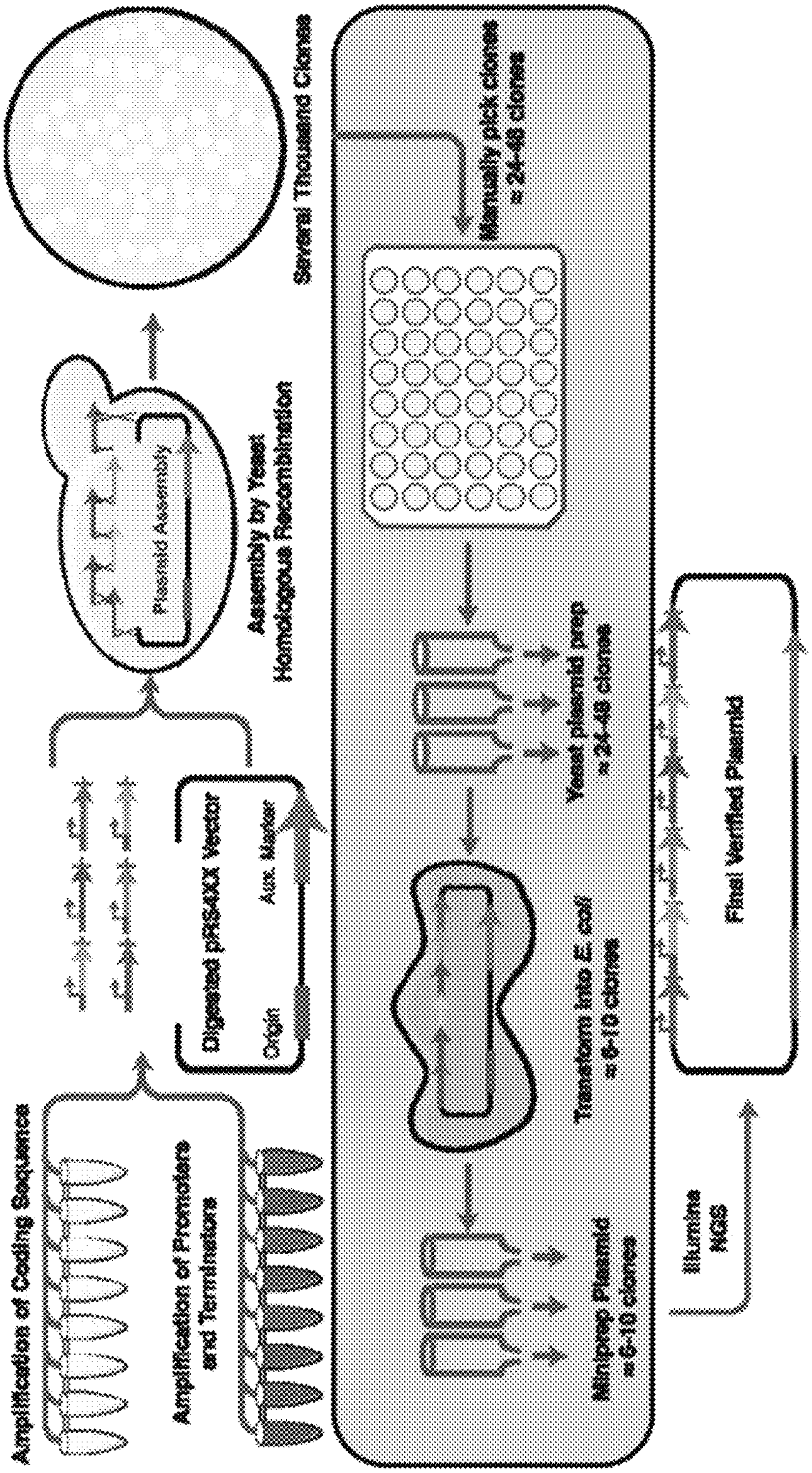
FIG. 11D illustrates a workflow for sequencing plasmids from yeast via a step of transforming the plasmids into *E. coli.*
Figure 11E:
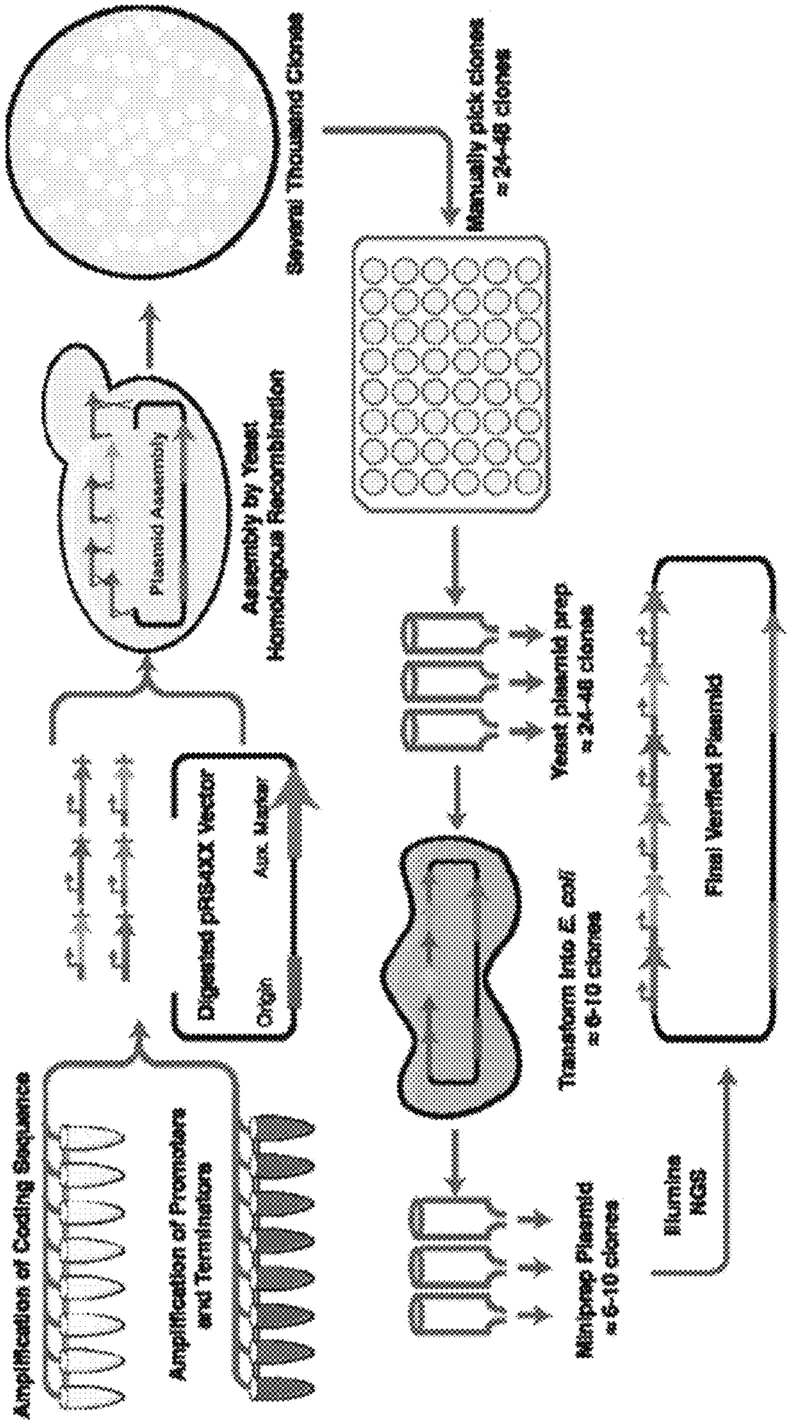
FIG. 11E illustrates a workflow for sequencing plasmids from yeast in accordance with methods described herein.

The sequencing of plasmid DNA directly out of yeast as in FIG. 11E (e.g. without transforming into another host such as *E. coli* as in FIG. 11D) is an advantage of the methods described herein. In establishing these methods, multiple means of preparation for both the plasmid DNA and the next-generation sequencing (NGS) library prep were tested. Shown in FIG. 11B is a comparison of sequencing efficiency using DNA prepared both from colonies picked from plates and cell pellets collected from 1 ml of liquid culture. These data show that these approaches generate samples of equivalent purity.

Initially, the platform utilized an NGS library preparation in which the purified, exonuclease treated plasmid DNA was ultrasonically sheared, followed by end repair, A-tailing, and adaptor ligation. In order to decrease labor and increase throughput, a recently published modification of the Illumina NexeraXT transposase based prep was performed (M. Baym, et al., *PLoS One* 10:e01280367, 2015). Ultrasonic shearing necessitated the serial processing of multiple plates of clones while tagmentation allows for parallel processing of multiple plates. FIG. 11C demonstrates that this modified Nextera preparation provides equivalent efficiency as compared to the standard approach.

This approach may be suitable for multiple DNA preparation methods in multiple strain backgrounds. Additionally, it was shown that this approach is compatible with various library preparations for sequencing on Illumina platforms. It is anticipated that this approach could be easily modified to function in sequencing workflows using alternate sequencing platforms such as those provided by Pacific Bioscience and Oxford Nanopore technologies.

Host Cells

The expression vectors may be transfected into a host cell to produce secondary metabolites. The host cell may be any cell capable of expressing the coding sequences from the expression vectors. The host cell may be a cell which can be grown and maintained at a high density. For example the host cell may be one which may be grown and maintained in a bioreactor or fermenter. The host cell may be a fungal cell, a yeast cell, a plant cell, an insect cell or a mammalian cell.

In some cases the host cell is bacterial. The bacteria may be a Proteobacteria such as a Caulobacteria, a phototrophic bacteria, a cold adapted bacteria, a Pseudomonads, or a Halophilic bacteria; an Actinobacteria such as Streptomycetes, Norcardia, Mycobacteria, or Coryneform; a Firmicutes bacteria such as a Bacilli, or a lactic acid bacteria. Examples of bacteria which may be used include, but are not limited to: *Caulobacter crescentus, Rodhobacter sphaeroides, Pseudoalteromonas haloplanktis, Shewanella* sp. strain Ac10, *Pseudomonas fluorescens, Pseudomonas putida, Pseudomonas aeruginosa, Halomonas elongata, Chromohalobacter salexigens, Streptomyces lividans, Streptomyces griseus, Nocardia lactamdurans, Mycobacterium smegmatis, Corynebacterium glutamicum, Corynebacterium ammoniagenes, Brevibacterium lactofermentum, Bacillus subtilis, Bacillus brevis, Bacillus megaterium, Bacillus licheniformis, Bacillus amyloliquefaciens, Lactococcus lactis, Lactobacillus plantarum, Lactobacillus casei, Lactobacillus reuteri*, and *Lactobacillus* gasseri.

In some cases the host cell is a fungal cell. In some cases, the host cell is a yeast cell. Examples of yeast cells include, but are not limited to *Saccharomyces cerevisiae, Saccharomyces pombe, Candida albicans*, and *Cryptococus neoformans*. In some cases the host cell may be a filamentous fungi, such as a mold. Examples of molds include, but are not limited to *Acremonium, Alternaria, Aspergillus, Cladosporium, Fusarium, Mucor, Penicillium*, and *Rhizopus*. In some cases, the host cell may be an *Acremonium* cell. In some cases, the host cell may be an *Alternaria* cell. In some cases, the host cell may be an *Aspergillus* cell. In some cases, the host cell may be an *Cladosporium* cell. In some cases, the host cell may be an *Fusarium* cell. In some cases, the host cell may be a *Mucor* cell. In some cases, the host cell may be a *Penicillium* cell. In some cases, the host cell may be a *Rhizopus* cell.

In some cases, the host cell is an insect cell. In some cases the host cell is a mammalian cell. Examples of mammalian cell lines include HeLa cells, HEK293 cells, B16 melanoma cells, Chinese hamster ovary cells, or HT1080. In some cases, the host cell is a plant cell. In some cases, the host cell may be part of a multicellular host organism.

In some cases, the host cell is a genetically engineered cell. The yeast strain BJ5464 has historically been a workhorse strain for expression of heterologous proteins. BJ5464 lacks two vacuolar proteases genes (PEP4 and PRB1), which makes the strain useful for biochemical studies, owing to reduced protein degradation. However, BJ5464 has several problems that limit its utility. It has a high rate of petite cell formation, which results in offspring that cannot respire (grow on ethanol as a carbon source) and cannot express the respiration-induced promoters used in this project. It is not genetically tractable because it cannot sporulate, and its non-deletion auxotrophic markers prevent facile genome editing. Finally, BJ5464 is slow growing.

This disclosure includes a new yeast super host based on the BY background. BY is a direct descendent of the yeast genome sequence reference strain and contains the complete deletions of auxotrophic markers that facilitate genome editing. It is the basis of the barcoded deletion collection, which has led to a wealth of genetic and chemico-genomic data. However, it also has major problems limiting its utility. In particular, it has the poorest sporulation frequency and highest petite frequency of all common lab strains.

The petite phenotype arises due to a defect in aerobic respiration. Petite yeasts are unable to grow on non-fermentable carbon sources (for example glycerol or ethanol), and form small anaerobic-sized colonies when grown in the presence of fermentable carbon sources (for example glucose). The phenotype results from mutations in the mitochondrial genome, loss of mitochondria, or mutations in the host cell genome.

Figure 12:
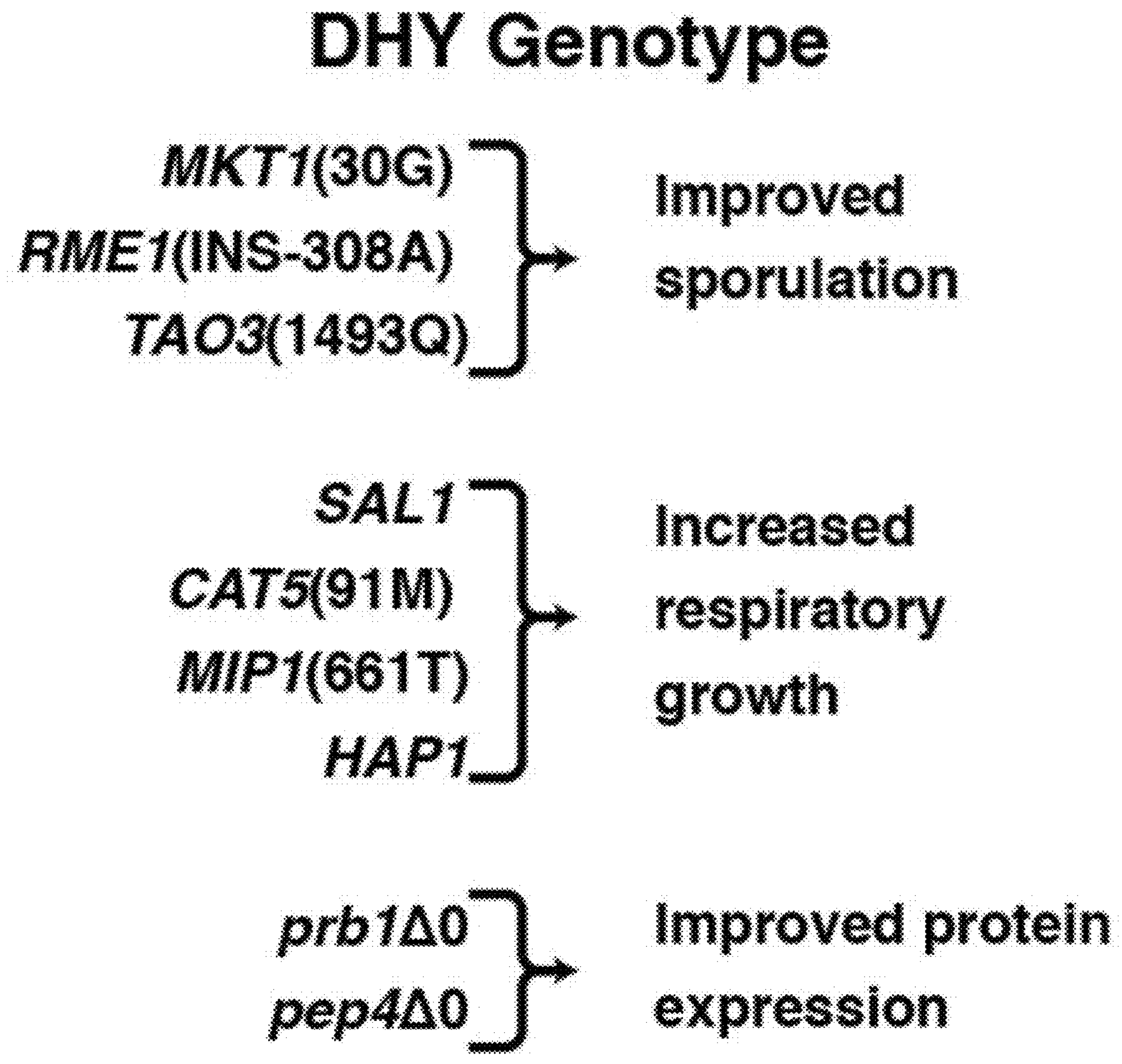
FIG. 12 illustrates repaired SNPs in yeast strain DHY674 relative to BY4741.

The genes and single nucleotide polymorphisms (SNPs) responsible for the sporulation and respiration defects have been identified (FIG. 12). The sporulation defect may be repaired by a series of genetic crosses to a previously repaired strain. The respiration problem caused by mitochondrial genome instability may also be corrected using genome editing. Genome editing may be performed with any method know in the art, such as the 50:50 method. (J. Horecka and R. W. Davis. *Yeast* 31:103-12, 2014). In some cases, an improved version of Mega 50:50 may be used in which a double stranded break is introduced into the genomic locus to be modified, increasing efficiency by several orders of magnitude (J. D. Smith, et al., *Mol. Syst. Biol.* 13:913, 2017).

In some cases, the host cell may be a cell which has been engineered to repair a sporulation defect. For example, the host cell may be a fungal cell with a repaired sporulation defect. In some cases, the host cell is a yeast cell with a repaired sporulation defect. In some cases, the host cell is a BY yeast cell in which the sporulation defect has been repaired, as in FIG. 12.

Figure 13:
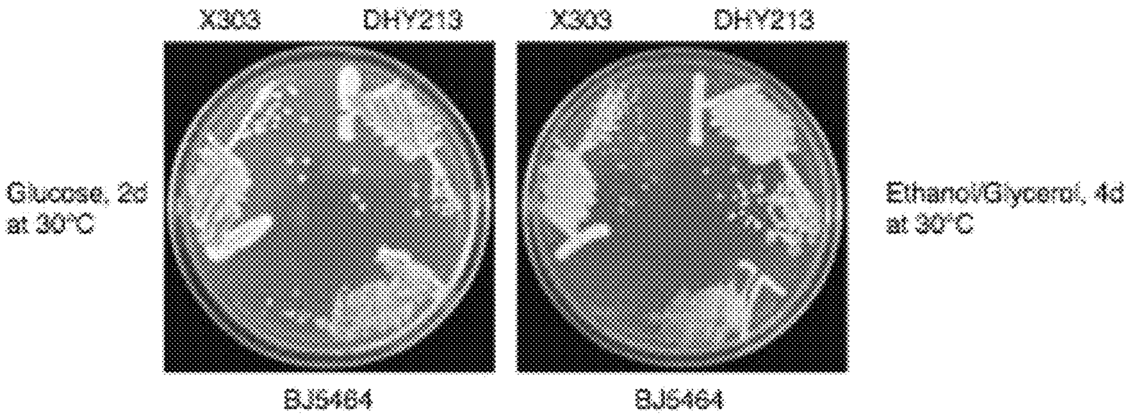
FIG. 13 illustrates DHY213, BJ5464, and X303 (a W303 derivative) grown on glucose (fermentation) and ethanol/glycerol (respiration) media.
Figure 14A:
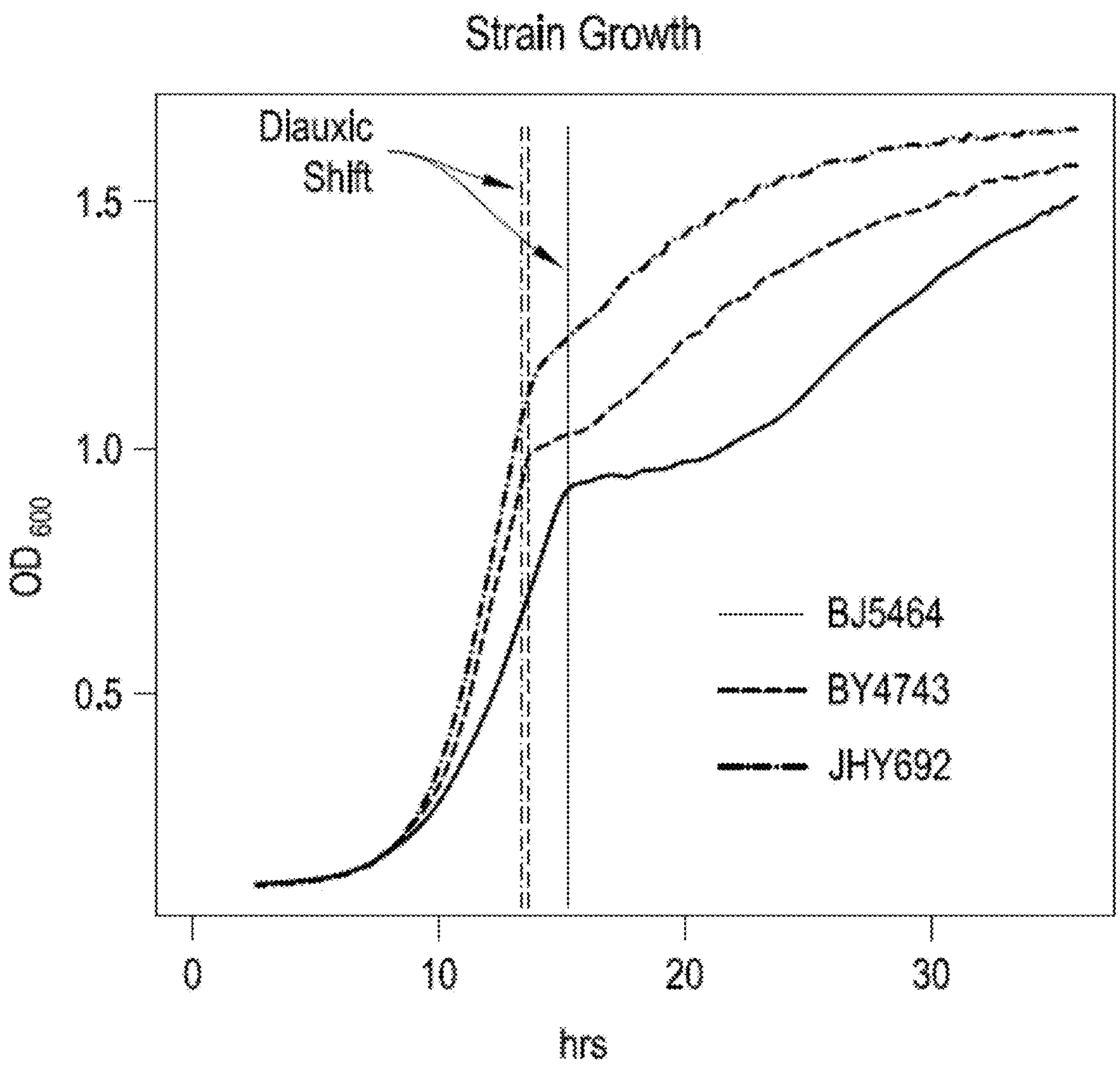
FIG. 14A illustrates relative growth rates of strains described here in YPD culture. The dotted line denotes the diauxic shift (the point at which the culture exhausts all glucose and transitions from fermentation to respiration). The DHY derived strain JHY692 shows significantly improved growth in the respiration phase of the culture.

In some cases, the host cell may be a cell which has been engineered to repair a respiratory defect or a mitochondrial genome instability defect. For example, the host cell may be a fungal cell with a repaired mitochondrial stability defect. In some cases, the host cell is a yeast cell with a repaired mitochondrial stability defect. In some cases, the host cell is a BY yeast cell in which the mitochondrial genome instability defect has been repaired, as in FIG. 12. In some cases, the host cell may be a cell in which both a sporulation defect and a mitochondrial genomic instability defect have been repaired. Using the genetic crosses and genome engineering methods discussed above and the genomic repairs outlined in FIG. 12 the BY strain was engineered to repair the mitochondrial genome instability. An unexpected benefit of repairing the mitochondrial genome instability defect was that the strains grew faster on non-fermentable carbon sources, such as ethanol (see FIGS. 13 and 14A). This is commonly the growth condition of choice for expression of heterologous genes, which are often linked to production-phase promoters activated by growth on non-fermentable carbon sources.

In some cases, the host cell may be genetically engineered to lack a gene involved in non-homologous end joining. The lack of such a gene may increase the efficacy of homologous recombination in such an engineered cell. The appropriate genes to delete may vary in each host. As an example, an engineered yeast host cell may lack a ligase such as the DNL4 DNA ligase. An engineered bacterial host cell may lack one or both of a Ku homodimer and the multifunctional ligase/polymerase/nuclease LigD. Other genes which may be involved in non-homologous double stranded break repair, depending on species, include: Mre11, Rad50, Xrs2, Nbs1, DNA-PKcs, Ku70, Ku80, DNA ligase IV, XLF, Artemis, XRCC4, Dnl4, Lif1, XLF also known as Cernunnos, Nej1 and Sir2.

DHY strains have utility for expression of heterologous genes for heterologous compound production, as well as ability to perform homologous recombination and DNA assembly. This combination of abilities in one strain allows DNA assembly and production of heterologous compounds in the same strain, whereas previously these two steps were separated in previous types of yeast (BY for DNA assembly and BJ5464 for expression and small molecule production).

Figure 14B:
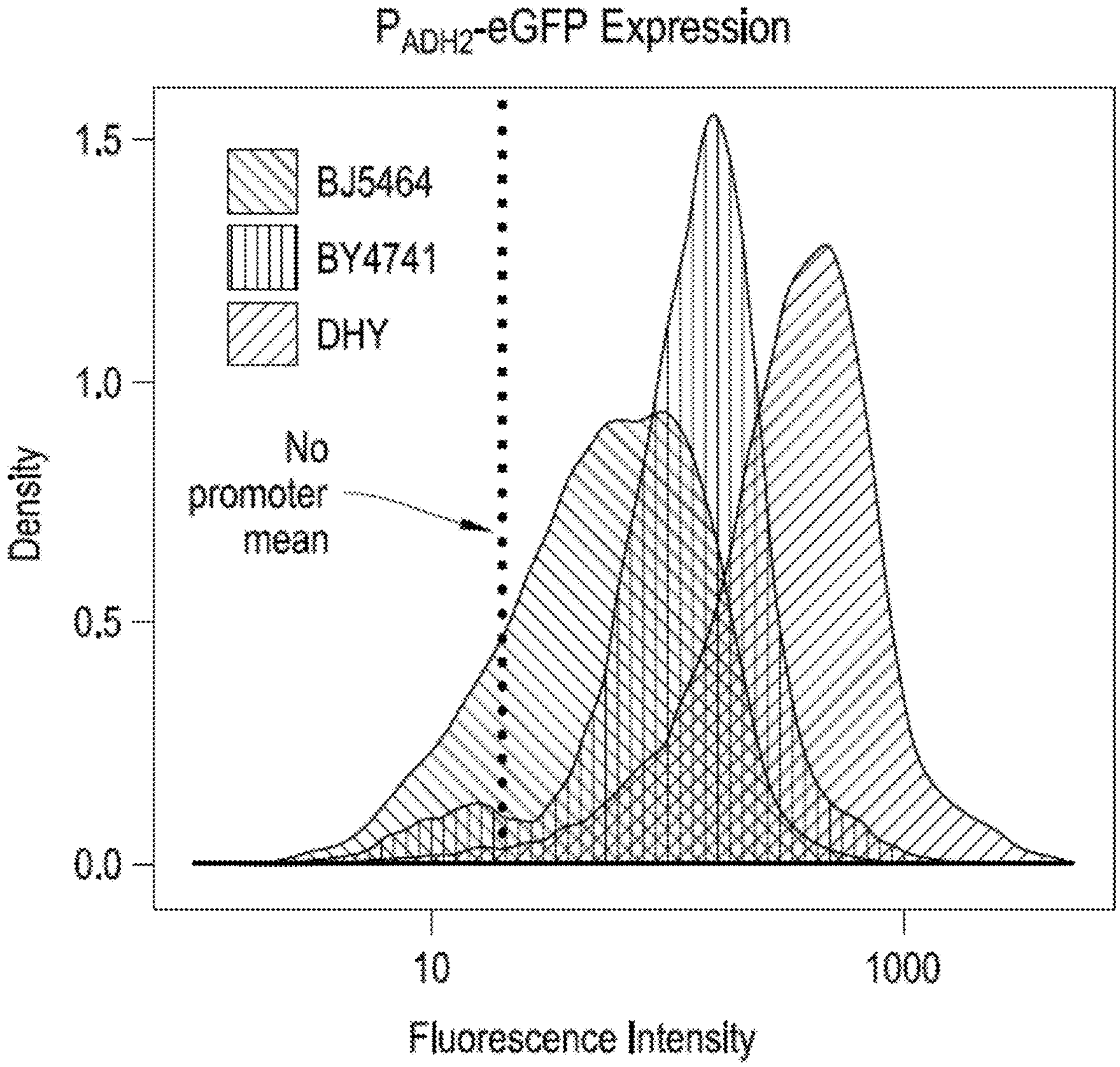
FIG. 14B illustrates expression of eGFP driven by the PADH2 promoter in the strains from FIG. 14A.
Figure 14C:
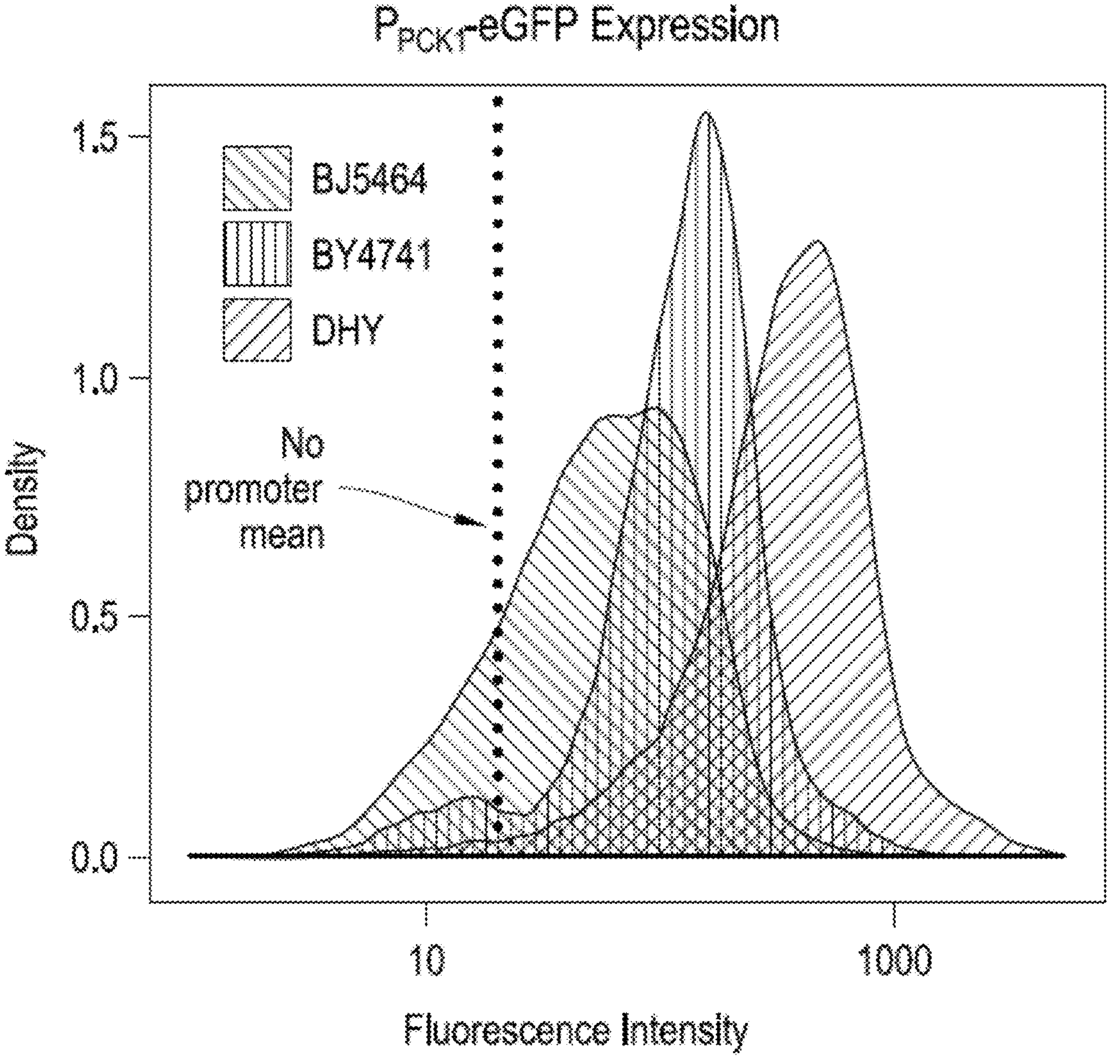
FIG. 14C illustrates expression of eGFP driven by the PPCK1 promoter in the strains from FIG. 14A.

These improvements can provide the DHY strain collection with a number of advantages over previous strains, particularly the BY strains: DHY can be faster-growing, result in fewer petite colonies (respiration-deficient), be genetically tractable, allow better expression from ADH2-like promoters, and allow both DNA assembly and production of heterologous products in the same strain (FIGS. 14B and 14C).

In some embodiments, a genetically engineered host cell lacks one or more conditionally essential genes which can be provided by a plasmid or other DNA vector. This allows for the selection of cells which are expressing the DNA vector. Examples of genes which may be used for this are auxotrophic genes which are required for biosynthesis of certain metabolites or genes for resistance to a toxin. Auxotrophic genes are only required when the specific metabolite they are required for is not present in the culture media. Resistance genes are only required when the toxin which they provide protection from is present.

Examples of genetically engineered yeast host cells include genetically engineered DHY super-host strains. In some cases, strains are based on the BY4741/BY4742 background (C. B. Brachmann, et al, *Yeast,* 14:115-32, 1998). Strains may also contain any of the following genetic changes from the BY background: sporulation repair (MKT1(30G) RME1(INS-308A) TAO3(1493Q)), and mitochondrial genome stability and function repair (CAT5(91M) MIP1(661T) SAL1+ HAP1+) (see FIG. 12). It should be noted, as would be understood in by persons having ordinary skill in the art, that any and all these genetic changes can be performed in isolation, in part, or in totality. For example, it is expected that the a single genetic change of either MKT1 (30G), RME1(INS-308A), or TAO3(1493Q) would result in at least some repair in sporulation activity. Likewise, a single genetic change of either CAT5(91M) or MIP1(661T) or restoration of function of SAL1 (SAL1+) or HAP1 (HAP1+) would result in at least some increase in mitochondrial genome stability.

In some cases, a strain may be a prototroph. For example, some strains may require methionine, arginine or lysine in the media. In some cases, a strain may be a full heterozygote for several markers from which any combination of markers can be made by tetrad dissection. For example, heterozygous for genes required for synthesis of histidine, leucine, uracil, lysine and methionine, or heterozygous for genes required for synthesis of histidine, leucine, uracil, lysine and arginine. Some examples of strains are listed in Table 3.

In some cases, the use of a strain as described herein allows for greater expression of BGC proteins and/or greater production of compounds from the BGCs. In some cases expression of heterologous proteins in a strain described herein is accomplished with an efficiency of at least 70%, 80%, 90%, 100%, 110%, 120%, 130%, 140%, or 150% as compared to heterologous protein expression in BJ5464. In some cases production of heterologous compounds in a strain described herein is accomplished with an efficiency of at least 70%, 80%, 90%, 100%, 110%, 120%, 130%, 140%, or 150% as compared to heterologous compound production in BJ5464.

TABLE 3

Description of strain genotypes

| Strain | Parent | Genotype | Reference |
| --- | --- | --- | --- |
| BY4741 | S288C | MATa his3Δ1 leu240 met15Δ0 ura3Δ0 | (C. B. Brachmann, et al., 1998, cited supra) |
| BY4743 | S288C | MATa/α his3Δ1/his3Δ1 leu2Δ0/leu2Δ0 LYS2/lys2Δ0 met15Δ0/MET15 ura3Δ0/ura3Δ0 | (C. B. Brachmann, et al., 1998, cited supra) |
| BJ5464 | | MATα ura3-52 trp1 leu2-Δ1 his3-Δ200 pep4::HIS3 prb1-Δ1.6R can1 GAL | (B. W. Jones, *Methods Enzymol.* 194:428-53, 1991) |
| BY4743ΔDNL4 | S288C | MATa/Matα dnl4Δ/dnl4Δ | (E. A. Winzeler, et al., *Science* 285:901-06, 1999) |
| Y800 | | MATa ade2-1 leu2-Δ98 ura3-52 lys2-801 trp1-1 his3-Δ200 [cir0] | (N. Burns, et al., *Genes Dev.* 8:1087-105, 1994) |
| DHY213 | BY4741 | MATa his3Δ1 leu2Δ0 ura3Δ0 met15Δ0 SAL1 + HAP1 + CAT5(91M) MIP1(661T) MKT1(30G) RME1(INS-308A) TAO3(1493Q) | n/a |
| JHY693 | DHY213 | MATa his3Δ1 leu2Δ0 ura3Δ0 met15Δ0 SAL1 + HAP1 + CAT5(91M) MIP1(661T) MKT1(30G) RME1(INS-308A) TAO3(1493Q) prb1Δ pep4Δ | n/a |
| JHY651 | DHY213 | MATα his3Δ1 leu2Δ0 ura3Δ0 met15Δ0 SAL1 + HAP1 + CAT5(91M) MIP1(661T) MKT1(30G) RME1(INS-308A) TAO3(1493Q) prb1Δ pep4Δ lys2Δ0 | n/a |
| JHY692 | DHY213 | MATa his3Δ1 leu2Δ0 ura3Δ0 met15Δ0 SAL1 + HAP1 + CAT5(91M) MIP1(661T) MKT1(30G) RME1(INS-308A) TAO3(1493Q) prb1Δ pep4Δ ADH2p-npgA-ACS1t | n/a |
| JHY705 | DHY213 | MATα his3Δ1 leu2Δ0 ura3Δ0 met15Δ0 SAL1 + HAP1 + CAT5(91M) MIP1(661T) MKT1(30G) RME1(INS-308A) TAO3(1493Q) prb1Δ pep4Δ ADH2p-CPR-ACS1t lys2Δ0 | n/a |
| JHY702 | DHY213 | MATa/MATα his3Δ1/his3Δ1 leu2Δ0/leu2Δ0 ura3Δ0/ura3Δ0 met15Δ0/met15Δ0 SAL1+/SAL1 + HAP1+/HAP1 + CAT5(91M)/CAT5(91M) MIP1(661T)/MIP1(661T) MKT1(30G)/MKT1(30G) RME1(INS-308A)/RME1(INS-308A) TAO3(1493Q/TAO3(1493Q)) prb1Δ/prb1Δ pep4Δ/pep4Δ ADH2p-npgA-ACS1t/ADH2p-CPR-ACS1t met15Δ0/+ lys2Δ0/+ | n/a |

Detection and Characterization of Novel Molecules

Once a host cell is expressing the coding sequences of the identified gene cluster, a secondary metabolite may be synthesized in the host cell. The secondary metabolite may be identified by any method known in the art. In some cases, the secondary metabolite is identified by comparing a host cell expressing the cluster with a host cell which does not express the cluster. This comparison may utilize chromatography methods to separate different small molecules produced in the cells. For example, column chromatography, planar chromatography, thin layer chromatography, gas chromatography, liquid chromatography, supercritical fluid chromatography, ion exchange chromatography, size exclusion chromatography be done by high performance liquid chromatography (HPLC), mass spectrometry (MS), or by mass spectrometry high performance liquid chromatography (MS-HPLC). Any peaks which appear for the cluster expressing host cell and not from the control host cell indicate the presence of a novel chemical. The comparison between the cluster expressing host cell and the control host cell may comprise a comparison of a cell extract, a culture media, or an extracted cell lysate.

Compounds Identified

This disclosure also provides sequences of 43 BGCs, and structures of novel products produced by a subset of these BGCs.

In one embodiment, this disclosure provides sequences of cryptic BGCs which encode various products, SEQ ID NOs: 67-483. These BGCs may also be reengineered to provide the coding sequences without the endogenous regulatory sequences. In some examples, the coding sequences may be predicted using known bioinformatics methods, experimental data, or obtained from databases such as default predicted gene coordinates (start, stop, and introns) as deposited in GenBank. Once the coding sequences have been identified the sequences may be isolated and cloned into one or more expression vectors for expression in a model host system such as *S. cerevisiae*.

The expression vectors may be plasmids, viruses, linear DNA, bacterial artificial chromosomes or yeast artificial chromosomes. Each of the one or more expression vectors may contain one or more promoters suitable for expression of a heterologous gene in a model host system. Each expression vector may contain a single coding sequence or multiple coding sequences. Multiple coding sequences may be functionally linked to a single promoter, for example via an internal ribosome entry site, or may be linked to multiple promoters. The expression vectors may also contain additional elements to regulate or increase the transcriptional activity, for example enhancers, polyA sequences, introns, and posttranscriptional stability elements. The expression vectors may also contain one or more selectable markers.

The expression vectors may be transfected, or otherwise introduced, into host cells. Examples of host cells include but are not limited to yeast and bacterial cells. For example a host cell may be a *S. cerevisiae* cell or an *E. coli* cell. Incubating the expression vectors in the host cells allows for the transcription and translation of the coding sequences to recreate the proteins of the gene cluster. These proteins may then produce a secondary metabolite which can be isolated from the cells or the media in which the cells are grown.

In another embodiment this disclosure provides host cell extracts containing non-host cell derived products. In some cases, these extracts may be produced by culturing host cells expressing one or more, or all, of the sequences from one of the following groups SEQ ID NOs: 67-76, 77-81, 82-91, 92-97, 98-106, 107-111, 112-118, 119-127, 128-135, 136-153, 154-157, 158-162, 163-172, 173-181, 182-186, 187-191, 192-199, 200-206, 207-211, 212-224, 225-228, 229-235, 236-240, 241-244, 245-255, 256-267, 268-276, 277-285, 286-289, 290-293, 294-307, 308-313, 314-318, 319-324, 325-329, 330-334, 335-341, 342-350, 351-357, 358-367, 368-372, 373-380, 381-388, 389-395, 396-400, 401-406, 407-413, 414-423, 424-427, 428-439, 440-447, 448-453, 454-462, 463-471, 472-480, or 481-483. In some cases, a host cell may express all the sequences from one of the following groups SEQ ID NOs: 67-76, 77-81, 82-91, 92-97, 98-106, 107-111, 112-118, 119-127, 128-135, 136-153, 154-157, 158-162, 163-172, 173-181, 182-186, 187-191, 192-199, 200-206, 207-211, 212-224, 225-228, 229-235, 236-240, 241-244, 245-255, 256-267, 268-276, 277-285, 286-289, 290-293, 294-307, 308-313, 314-318, 319-324, 325-329, 330-334, 335-341, 342-350, 351-357, 358-367, 368-372, 373-380, 381-388, 389-395, 396-400, 401-406, 407-413, 414-423, 424-427, 428-439, 440-447, 448-453, 454-462, 463-471, 472-480, or 481-483. In some cases the host cell(s) may express one or more sequences selected from SEQ ID NOs: 67-483. After culturing the cells, they may be collected, lysed, and the small molecules may be purified from nucleic acid, proteins, complex carbohydrates and lipid containing fractions. The secondary metabolites produced may also be secreted into the cell media. In this case this disclosure also provides a cell media containing secondary metabolites.

This disclosure also provides compounds isolated from the host cell extracts or media. A compound of this disclosure may be Compound 1:

1

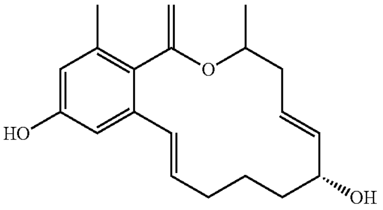

Compound 2

2

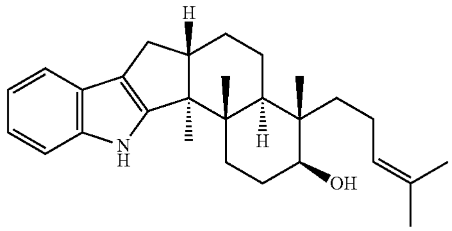

Compound 3

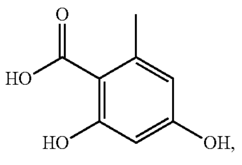

(orsellinic acid)

Compound 4

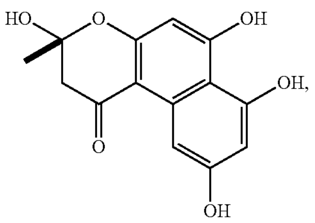

-continued

Compound 5

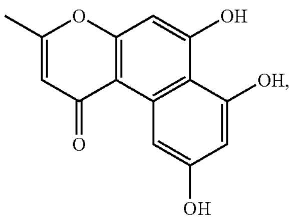

Compound 6

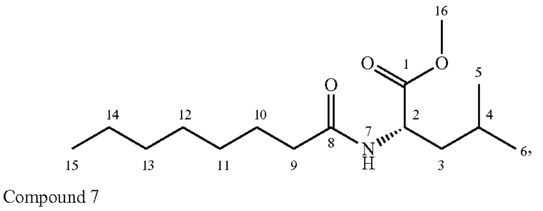

Compound 7

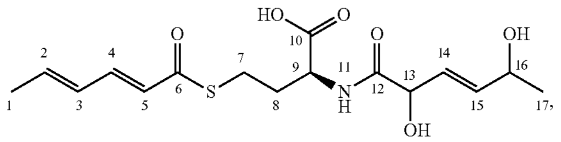

Compound 8

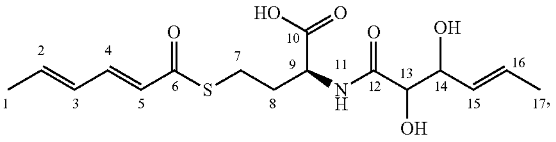

Compound 9 compound 9

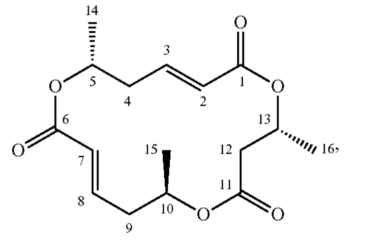

Compound 10

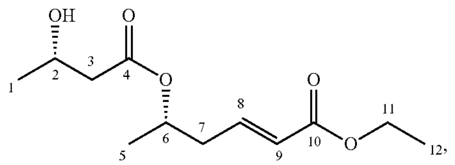

Compound 11 compound 11

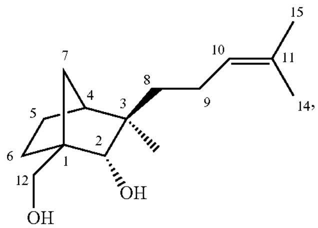

-continued

Compound 12 compound 12

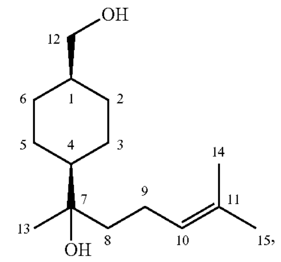

Compound 13 compound 13

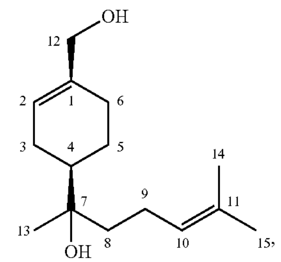

Compound 14 compound 14

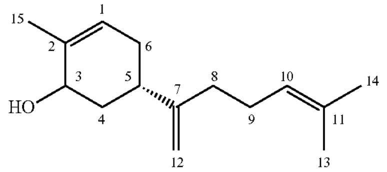

Compound 15 compound 15

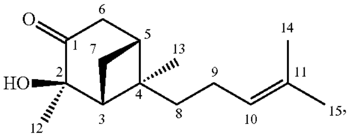

and

Compound 16 compound 16

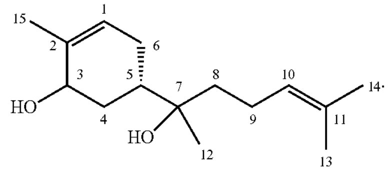

Compounds of this disclosure may have useful therapeutic applications, for example in treating or preventing a disease or disorder. Compounds of this disclosure may be used to treat an infection, for example a bacterial, fungal or parasitic infection. Compounds of this disclosure may have antibiotic and/or antifungal activities. Compound 8 and Compound 9 may have antimicrobial, antifungal and/or antibacterial activities. Compounds of this disclosure may have non-medical applications.

In some embodiments this disclosure provides pharmaceutical compositions comprising of a compound of this disclosure. In some cases a pharmaceutical composition contains at least one of Compounds: 6, 7, 8, 9, 10, 11, 12, 13, 14, 15, and 16. Compositions as described herein may comprise a liquid formulation, a solid formulation or a combination thereof. Non-limiting examples of formulations may include a tablet, a capsule, a gel, a paste, a liquid solution and a cream. The compositions of the present disclosure may further comprise any number of excipients. Excipients may include any and all solvents, coatings, flavorings, colorings, lubricants, disintegrants, preservatives, sweeteners, binders, diluents, and vehicles (or carriers). Generally, the excipient is compatible with the therapeutic compositions of the present disclosure. Generally, the excipient is a pharmaceutically acceptable excipient. The pharmaceutical composition may also contain minor amounts of non-toxic auxiliary substances such as wetting or emulsifying agents, pH buffering agents, and other substances such as, for example, sodium acetate, and triethanolamine oleate.

In some embodiments this disclosure provides a method of synthesizing a compound described herein. The method may include steps of providing one or more coding sequences of SEQ ID NOs: 67-483 in a suitable vector, or vectors, together with regulatory sequences which will drive expression of the coding sequences in a host cell. The vector, or vectors, are then provided to a host cell, such as for example a yeast cell, and the cells are grown under conditions that allow for the expression of the coding sequences. In some cases, a host cell may be provided with 1, 2, 3, 4, 5, 6, or more than 6 different plasmids. The synthesized compound may be purified from the cell culture by centrifuging the cells to produce a cell pellet and a supernatant. The supernatant and cell pellet may be extracted using either ethyl acetate or acetone, or other suitable organic solvent. For compounds containing carboxylic acid groups, the pH of the supernatant may be adjusted to pH of 4 or less (e.g., 3) with an acid such as HCl prior to extraction. After extraction, both organic phases are combined and evaporated to dryness. The compounds may then be dissolved in the desired solvent and further purified using standard purification methods.

Although the present disclosure has been described in certain specific aspects, many additional modifications and variations would be apparent to those skilled in the art. In particular, any of the various processes described above can be performed in alternative sequences in order to achieve similar results in a manner that is more appropriate to the requirements of a specific application. It is therefore to be understood that embodiments of the present disclosure can be practiced otherwise than specifically described without departing from the scope and spirit of the present disclosure. Thus, embodiments of the present disclosure should be considered in all respects as illustrative and not restrictive.

Example 1: Identification of Production Phase Promoters

Biological data supports the systems and constructs of production-phase promoter DNA vectors and applications thereof. Provided below are several examples of incorporating production-phase promoters into DNA vectors. Some of these vectors were used to produce biosynthetic products from multi-gene clusters derived from various fungal species. Compared to a constitutive promoter system, production-phase promoter systems in accordance with various embodiments produced several-fold greater product.

Production Phase Promoter Expression Analysis

Because the ADH2 promoter (SEQ ID NO. 1) has properties of a production-phase promoter, a panel of promoter sequences was compared to the ADH2 promoter to identify other production-phase promoters. To begin, endogenous *S. cerevisiae* genes were identified that appeared co-regulated with ADH2 in a previous genome-wide transcription study (Z. Xu. et al., *Nature* 457:1033-37, 2009, the disclosure of which is incorporated herein by reference). In this study, transcription of yeast genes was quantified during mid-exponential growth in several types of growth media. Of the 5171 ORFs examined, 35 appeared co-regulated with ADH2, with co-regulation defined as a greater than two-fold increase in expression with a non-fermentable carbon source (ethanol in a yeast-peptone-ethanol (YPE) media) as compared to a fermentable carbon source (dextrose in a yeast-peptone-dextrose (YPD) media). Because these data were collected at a single time point and assessed transcription of genes in their native context, their ability to co-regulate heterologous genes in a production-phase promoter system required further validation and characterization.

A detailed characterization of the ability of 34 selected promoters to control expression of heterologous genes was performed. For this specific purpose, a promoter was defined as the shorter of (a) 500 bp upstream of the start codon, or (b) the entire 5' intergenic region. Each promoter was cloned upstream of the gene for monomeric enhanced GFP (eGFP) and integrated each of the resulting cassettes in a single copy at the ho locus of individual strains. Control strains were included in which strong constitutive FBA1 and TDH3 promoters were cloned upstream of eGFP in an identical manner. The 35 promoter sequences can be found in SEQ ID NOs. 2-35.

Figure 16:
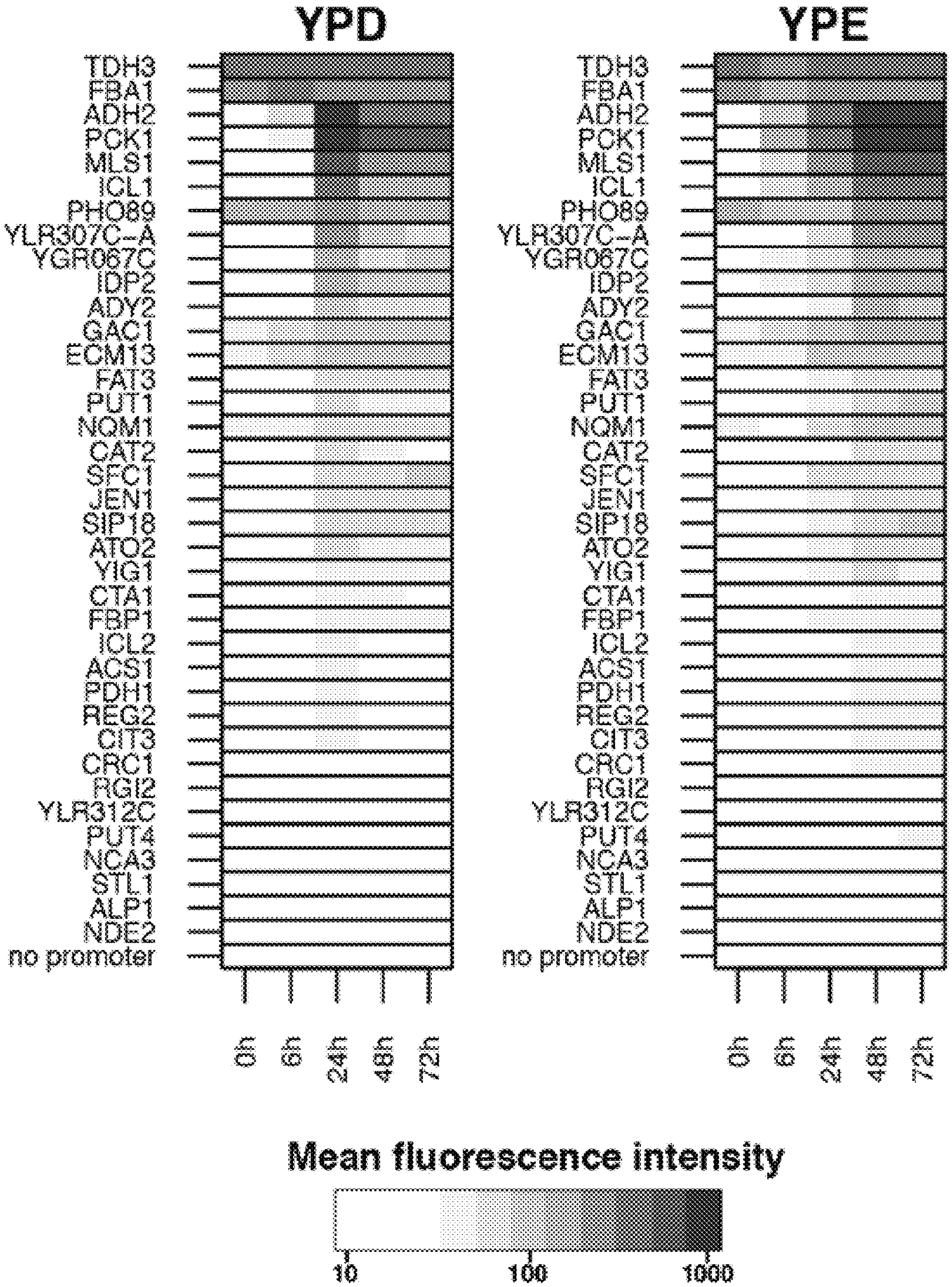
FIG. 16 is a heat map graphic generated in accordance with various embodiments of the disclosure with data of expression of enhanced-green fluorescent protein driven by various *S. cerevisiae* promoters.
Figure 17:
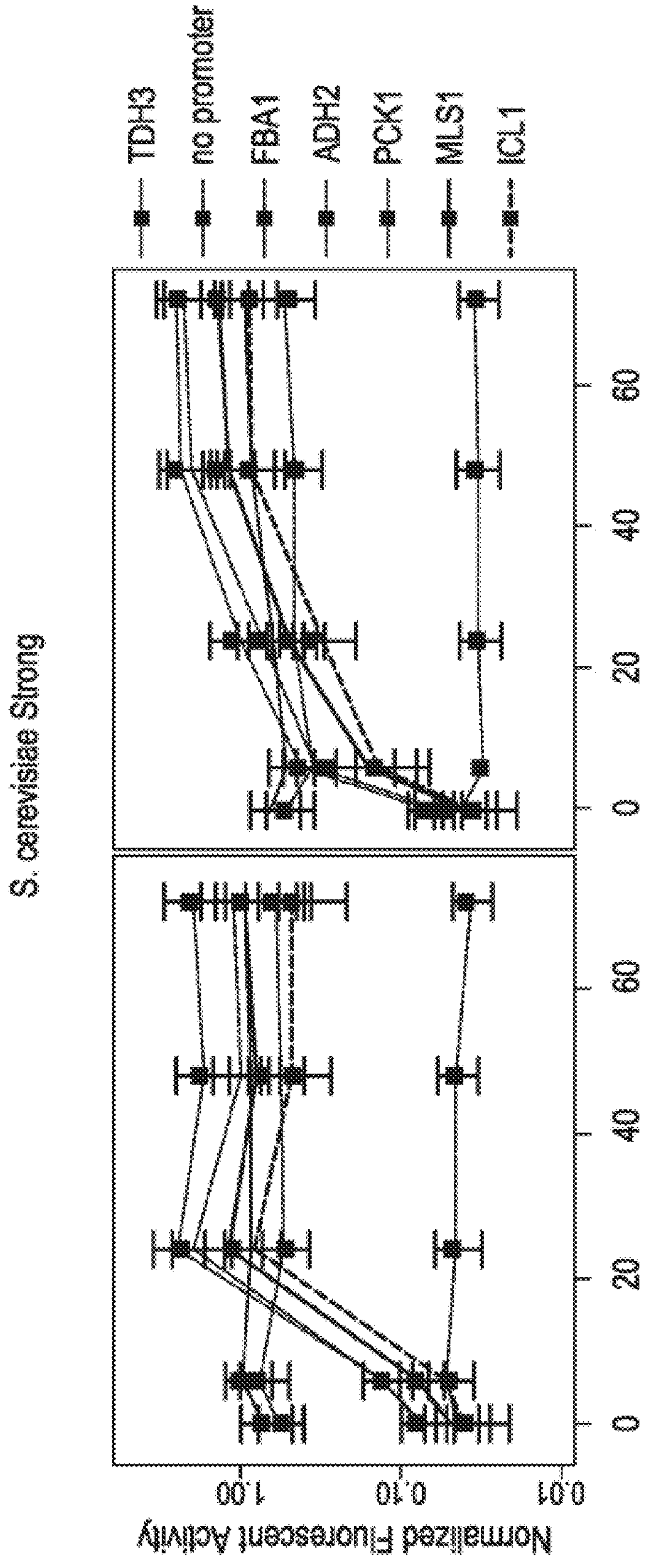
FIG. 17 is a data graph of enhanced-green fluorescent protein expression driven by various *S. cerevisiae* promoters.
Figure 17:
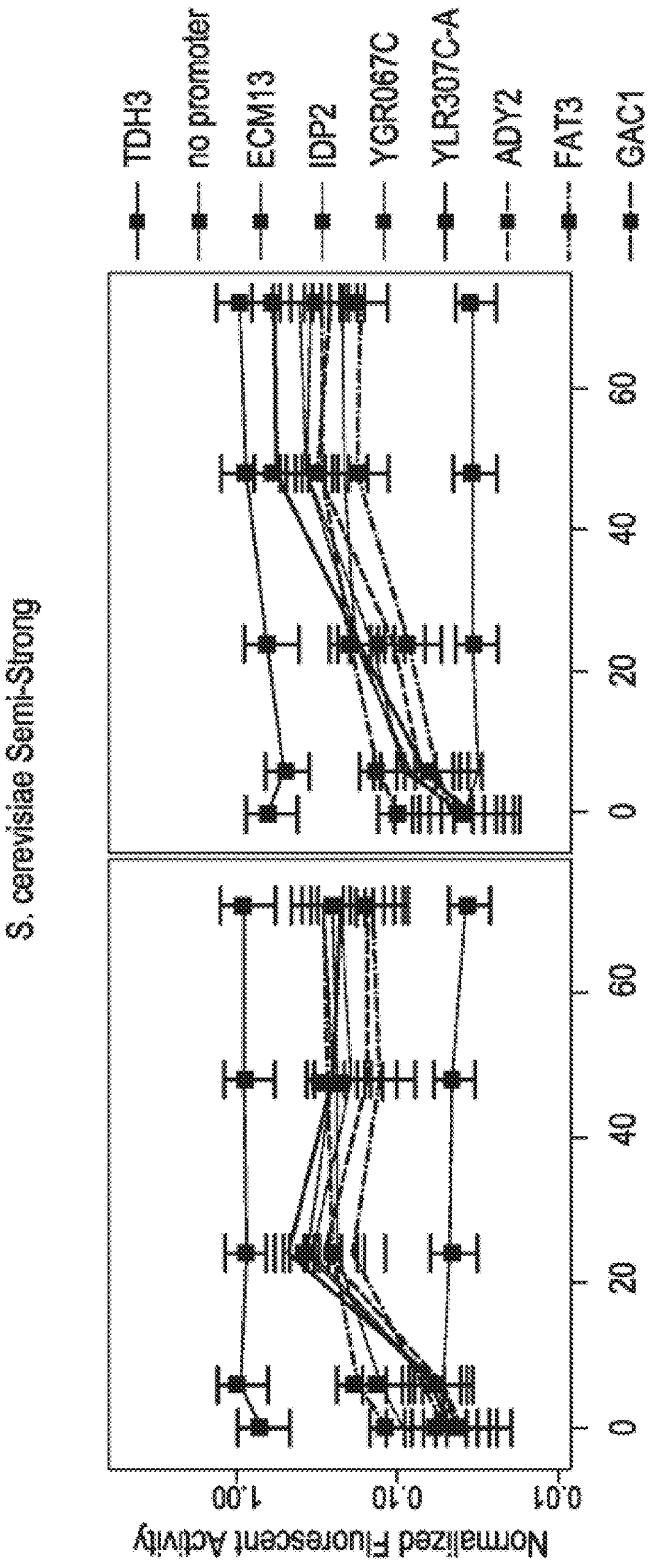
Figure 17:
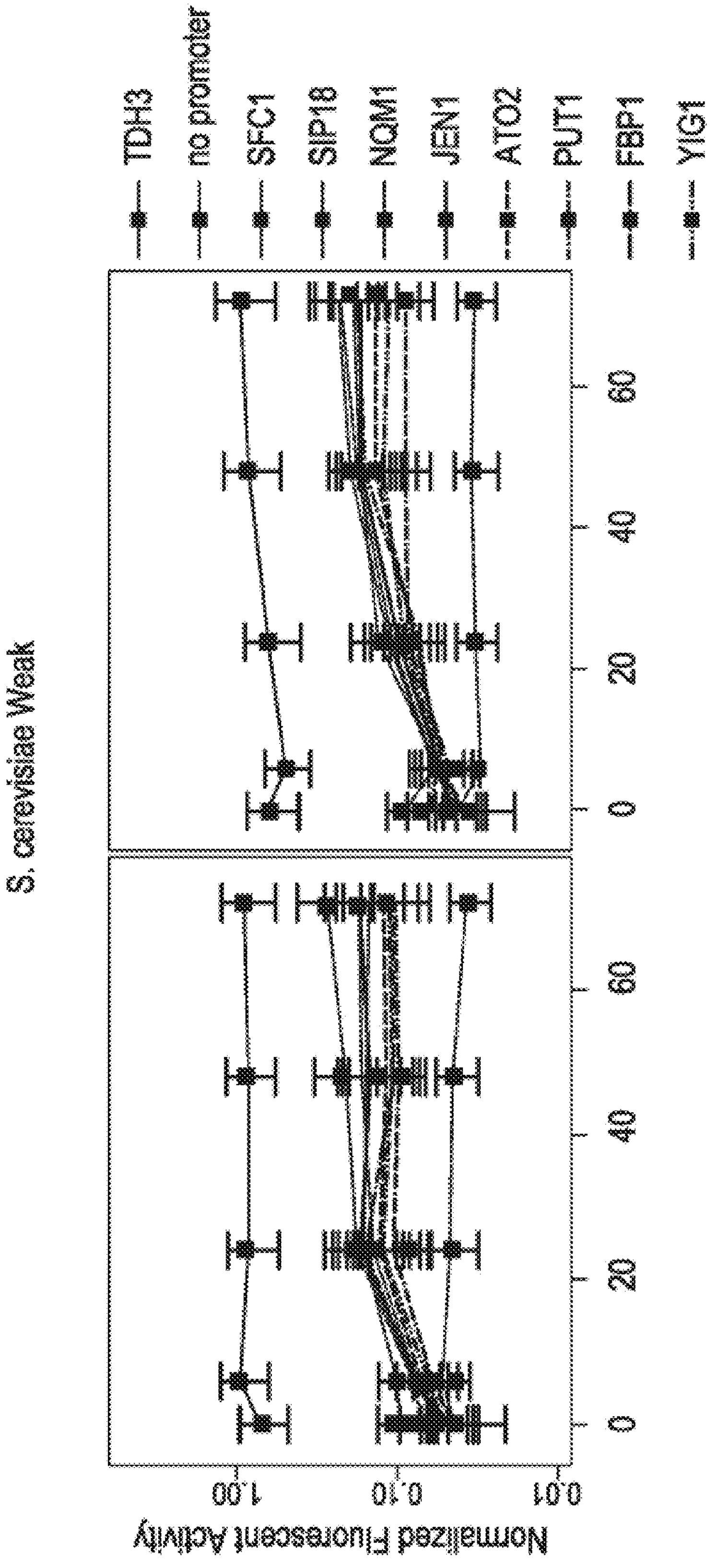
Figure 18:
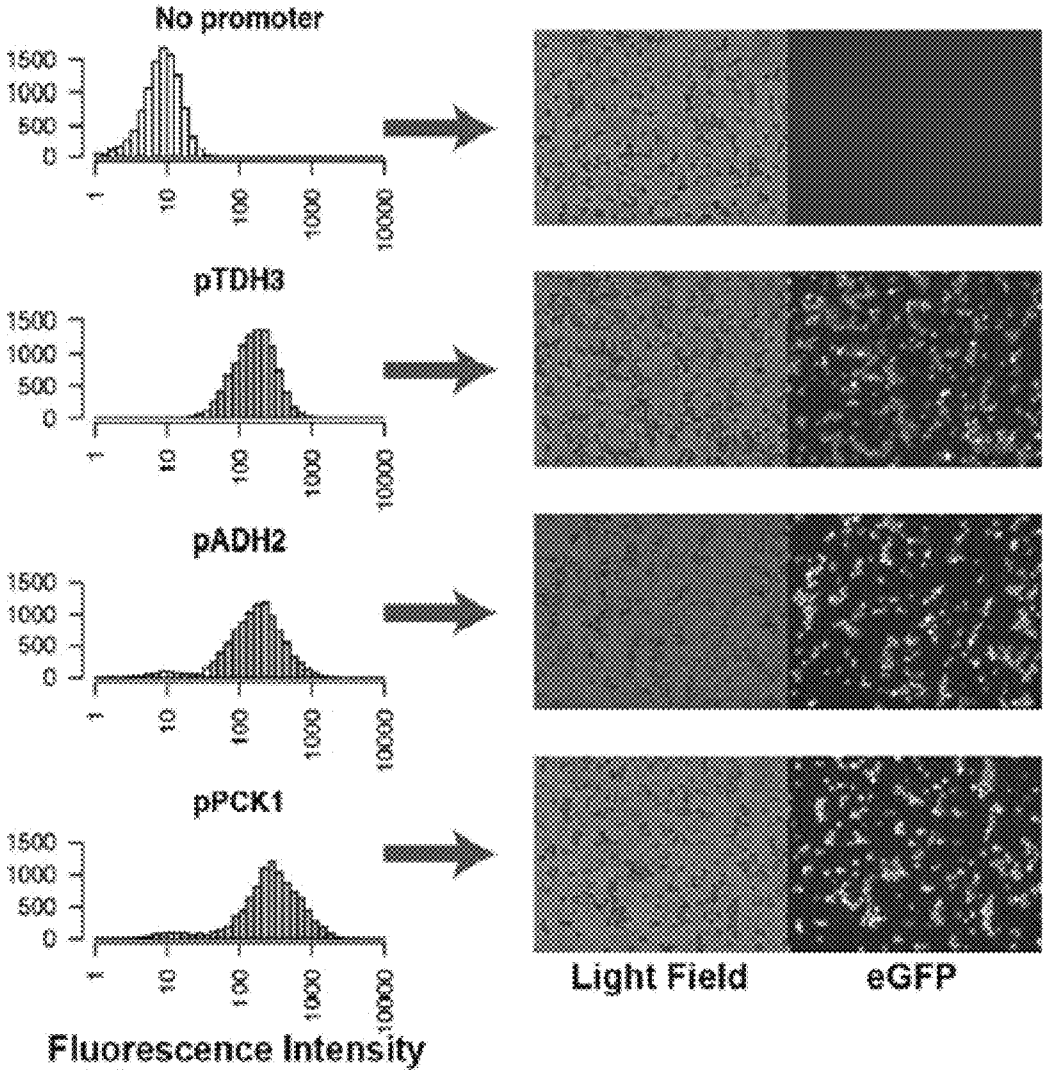
FIG. 18 illustrates fluorescence intensity of $10^5$ cells expressing enhanced-green fluorescent protein driven by various promoters.

In order to compare the 35 putative production-phase promoters, the expression of eGFP protein was assessed over 72 hours in each strain by flow cytometry in media with both fermentable (YPD) and non-fermentable (YPE) carbon sources (FIGS. 16 and 17). All cultures were started in YPD media and analysis of eGFP expression began when cells were in the midst of exponential fermentative growth ($OD_{600}$=0.4, 0 hrs). At this point, cells were either left to continue growth in YPD or spun-down and resuspended in YPE. Consistent with previous work, pADH2 was entirely repressed at the point where the experiment commenced (during exponential fermentative growth, 0 hrs) unlike the constitutive promoters pTDH3 and pFBA1, which were expressed at near maximum levels regardless of phase. Moderate expression from pADH2 was observed after a further 6 hours in YPD culture or following a growth media switch to YPE. Within 24 hrs, expression reached levels exceeding those observed in the strong constitutive systems. Cytometry histograms and fluorescence microscopy demonstrated that within 48 hours, >95% of all cells with pADH2 and pPCK1 driven expression were fluorescing above background (FIG. 18). Protein expression levels spanned 15-50 fold, with most showing little or no expression until 24 hours into the culture (FIGS. 16 and 17). Transgene expression driven by the PCK1, MLS1, and ICL1 promoters (SEQ ID NOs. 2-4) not only showed the same timing of expression as pADH2, but also expressed at an equivalently high level. The promoters of genes YLR307C-A, YGR067C, IDP2, ADY2, GAC1, ECM13 and FAT3 (SEQ ID NOs. 5-11) displayed semi-strong transgene expression (FIG. 16). In addition, the promoters of genes PUT1, NQM1, SFC1, JEN1, SIP18, ATO2, YIG1, and FBP1 (SEQ ID NOs. 12-19) displayed weak of transgene expression (FIGS. 16 and 17). The promoter PHO89 (SEQ ID NO. 20) did not exhibit strong repression in during the growth phase (FIGS. 16, 0 and 6 hours). The results of the other sequences are also depicted in FIG. 16 (SEQ ID NOs.

22-36). The constitutive promoters pTDH3 and pFBA1 (SEQ ID NOs. 50 and 52) were used as controls (FIGS. 16-18).

Figure 19:
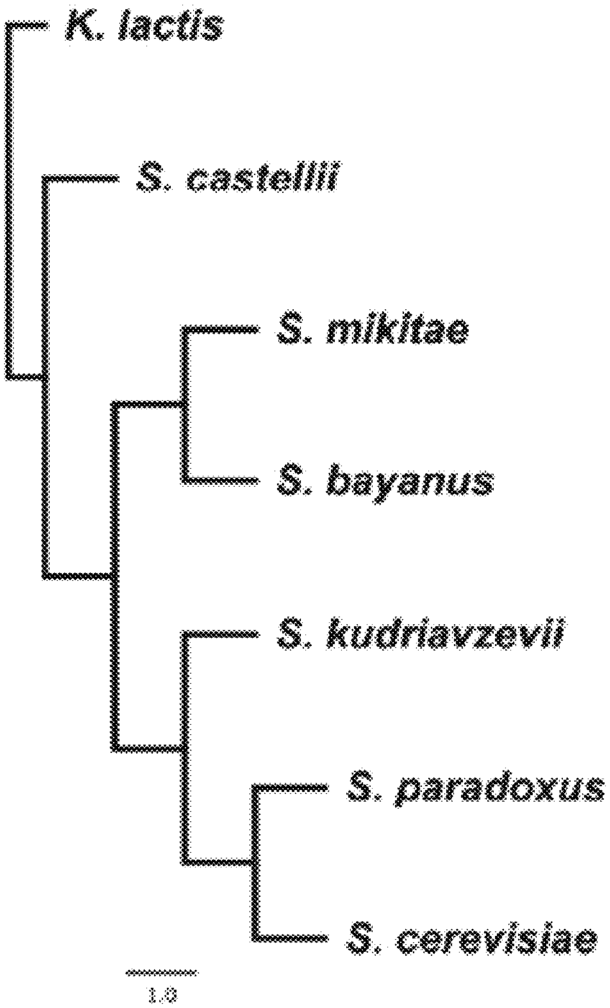
FIG. 19 illustrates a phylogenetic tree of *Saccharomyces* sensu *stricto* subgenus.
Figure 20:
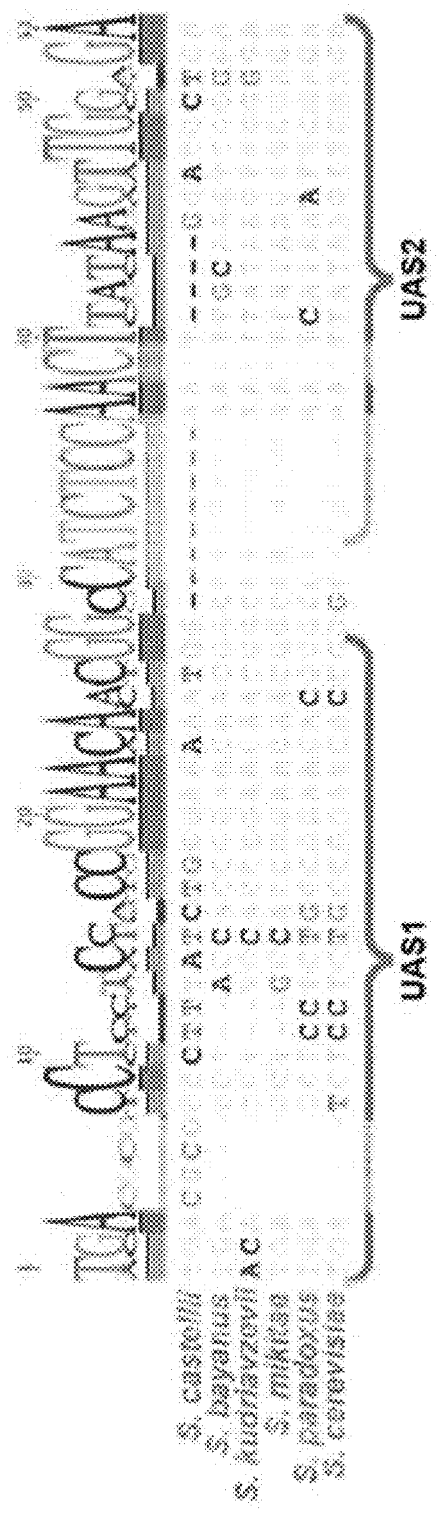
FIG. 20 illustrates a multiple sequence alignment of various *Saccharomyces* sensu *stricto* species' upstream activating sequences in ADH2 promoters. SEQ ID Nos. 36-40.
Figure 21:
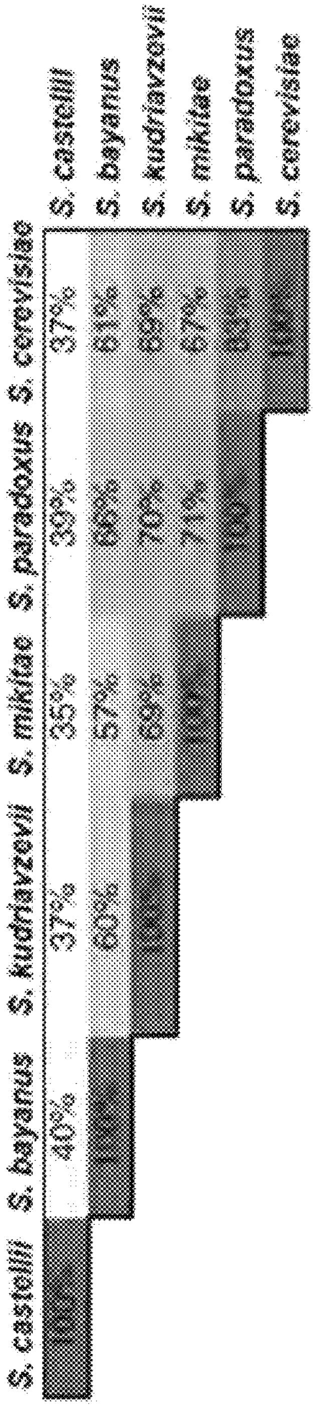
FIG. 21 illustrates homology between various *Saccharomyces* sensu *stricto* species' ADH2 promoters.

The above analysis identified a large set of co-regulated promoters spanning a wide range of expression levels, three of which were as strong as pADH2. However, a more extensive set of strong production-phase promoters is desirable for assembly of constructs having multi-gene pathways, especially pathways having more than four genes. To identify other production-phase promoter candidates, the genomes of five closely related species within the *S.* sensu *stricto* complex were examined (FIG. 19). The promoter region was identified for the closest ADH2 gene homolog in the genomes of *Saccharomyces bayanus, Saccharomyces paradoxus, Saccharomyces mikitae, Saccharomyces kudriavzevii*, and *Saccharomyces castellii*. Multiple sequence alignment of the upstream activation sequences (UAS) revealed that nearly all sequences (except that from *S. castellii*) are highly conserved across this region, suggesting a potential for regulation similar to that of *S. cerevisiae* ADH2 (FIG. 20, SEQ ID NOs. 36-40). In order to be used for single-step pathway assembly, all promoter sequences must be sufficiently unique to prevent undesired recombination between each other. Therefore, the pairwise identities for each of the *Saccharomyces* sensu *stricto* ADH2 promoter pairs were analyzed (FIG. 21). The most similar promoter to the *S. cerevisiae* ADH2 promoter is that from *S. paradoxus*, with 83% identity, including a single 40 bp stretch located near the center of the promoter. This homology is significantly less than the 50-100 bp typically used for assembly by yeast homologous recombination, and recombination events between sequences with this level of identity occur at very low frequency, suggesting that these promoters should be compatible with a multi-gene assembly technique utilizing yeast homologous recombination as described above.

Figure 22:
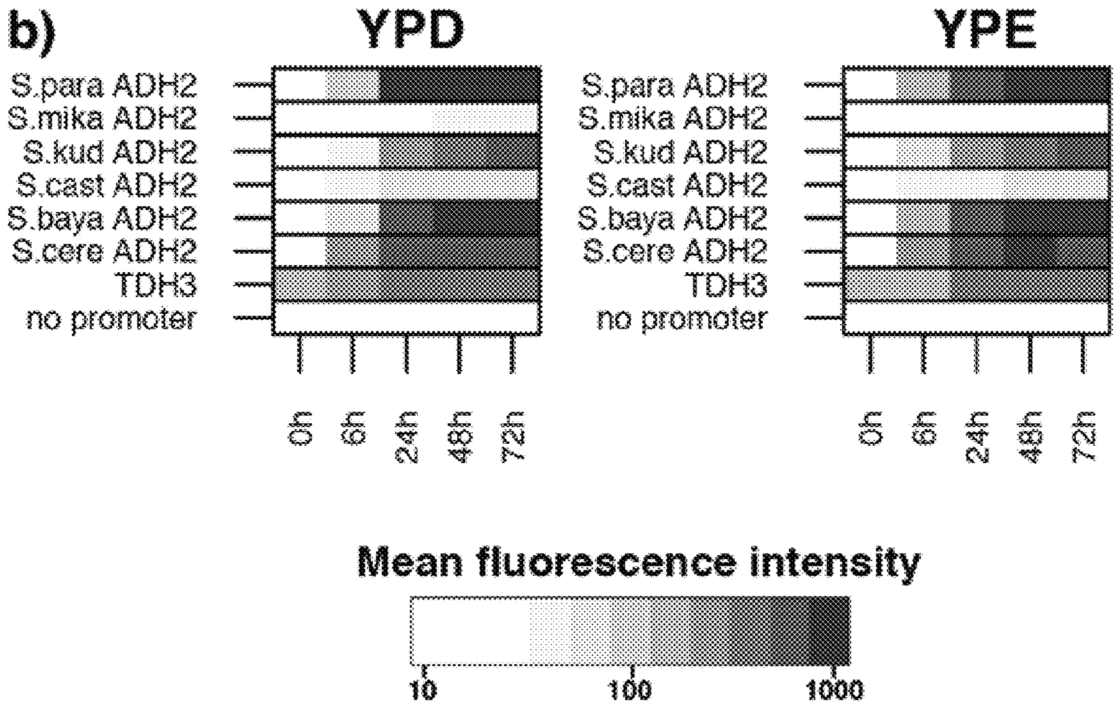
FIG. 22 is a heat map graphic generated in accordance with various embodiments of the disclosure with data of expression of enhanced-green fluorescent protein driven by various *S.* sensu *stricto* ADH2 promoters.
Figure 23:
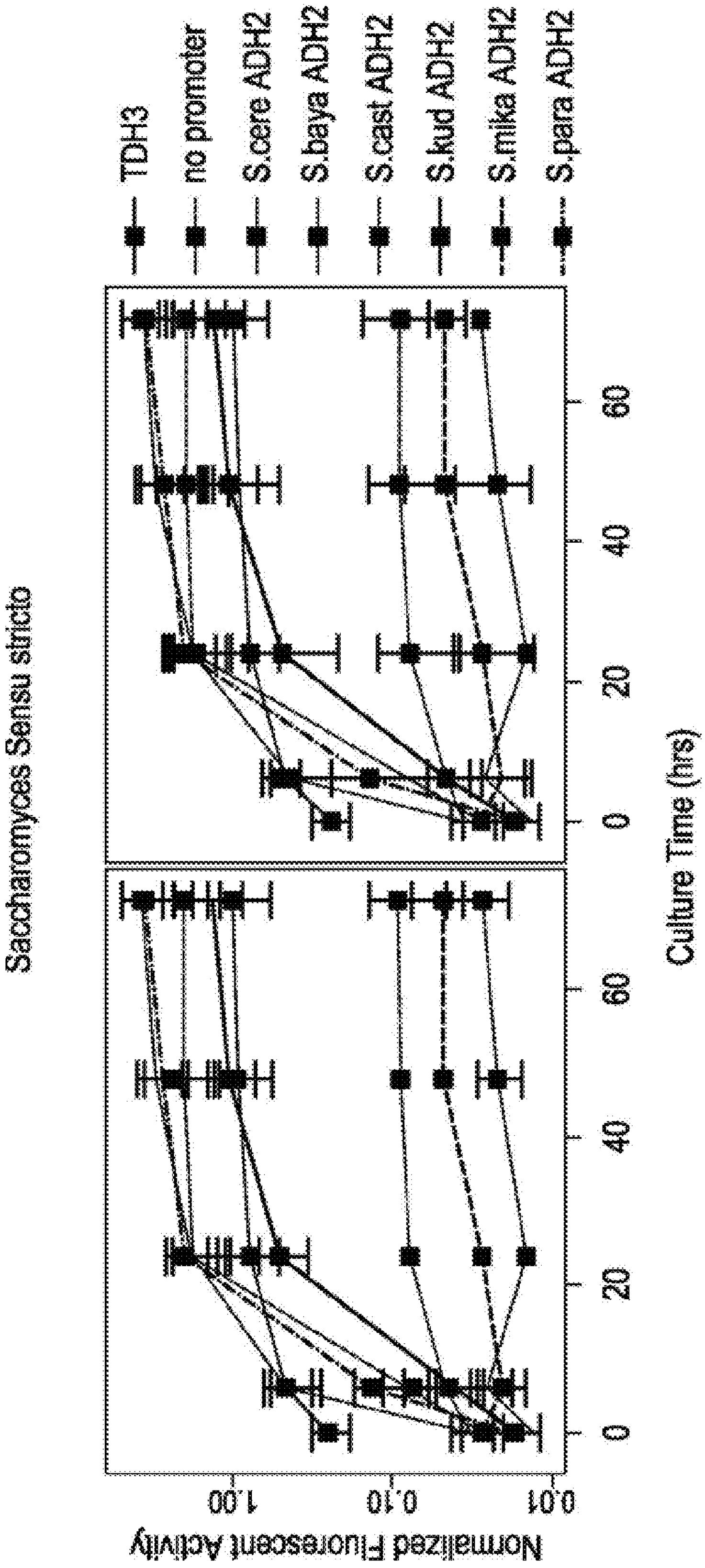
FIG. 23 is a data graph of enhanced-green fluorescent protein expression driven by various *S.* sensu *stricto* ADH2 promoters.

As with the endogenous yeast promoter candidates, these other putative *Saccharomyces* promoters required detailed characterization of induction profiles. DNA encoding each of these promoter sequences was obtained by commercial synthesis and characterized expression of eGFP from each promoter in the same manner as the endogenous yeast promoters (FIGS. 22 and 23). Of the five *Saccharomyces* sensu *stricto* pADH2s tested (SEQ ID NOs. 36-40), the promoters derived from *S. paradoxus, S. kudriavzevii*, and *S. bayanus* show timing and strength of expression equivalent to that of *S. cerevisiae* pADH2. In combination with the endogenous yeast promoters, these three additional *Saccharomyces* pADH2s expand the number of strong promoters with the desired induction profile.

Figure 24:
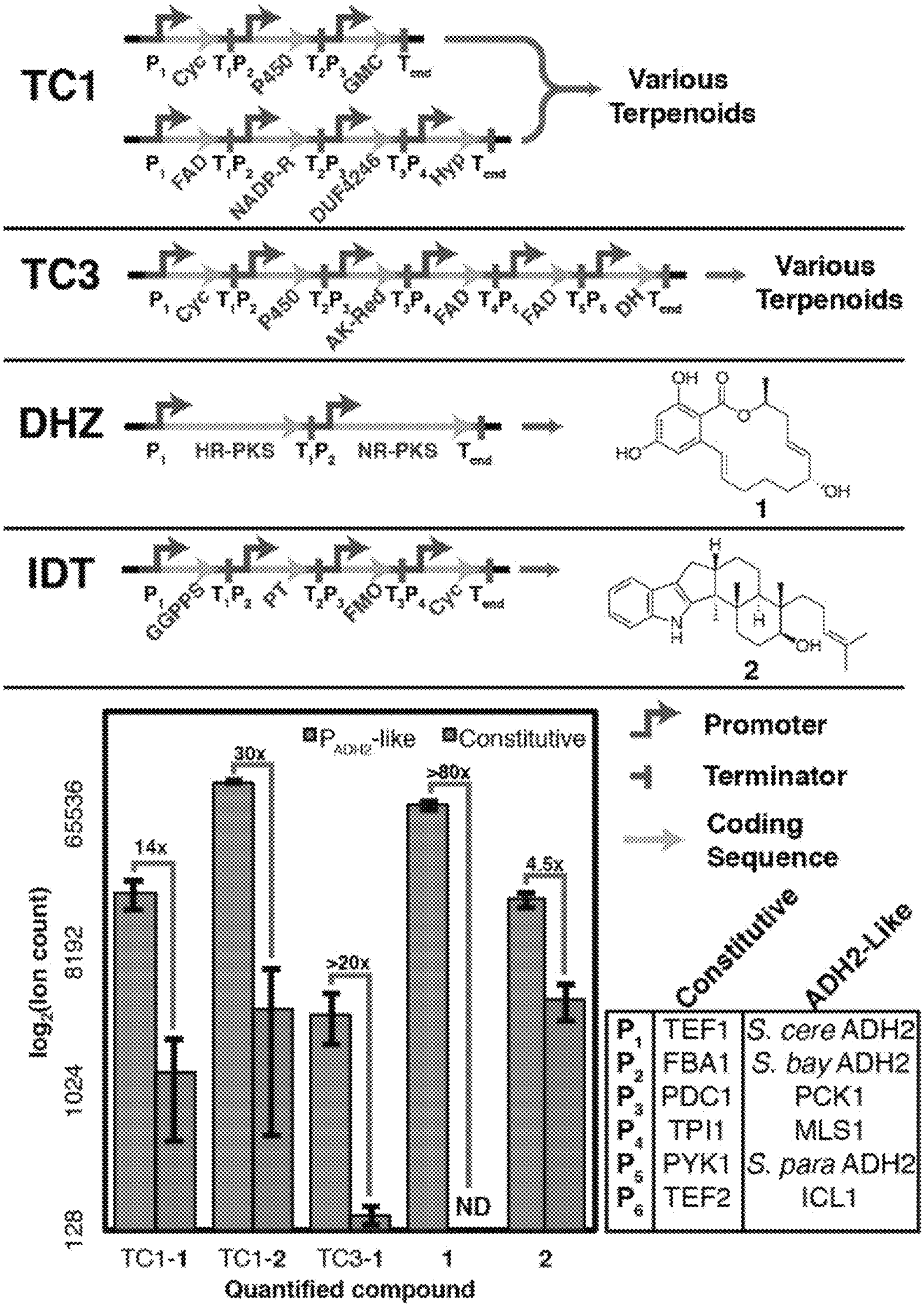
FIG. 24 illustrates four multi-gene expression vector constructs and a data graph of the resultant compound production, in accordance with an embodiment of the invention.
Figure 25:
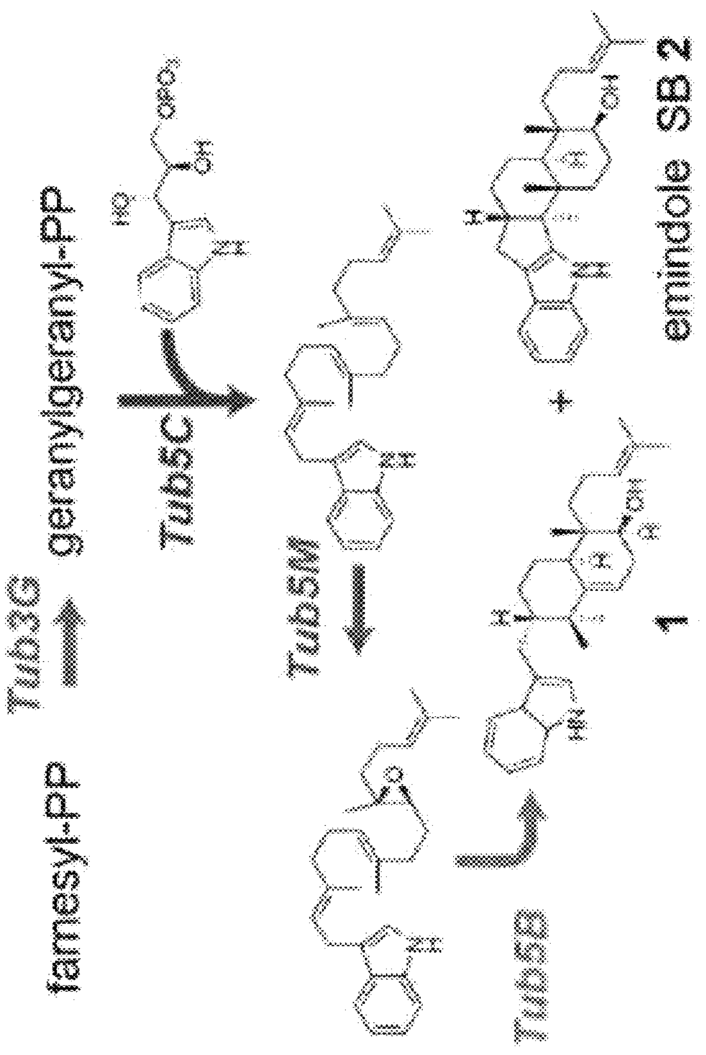
FIG. 25 illustrates a biosynthetic process that produces the compound emindole SB via a fungal four-gene cluster.
Figure 26:
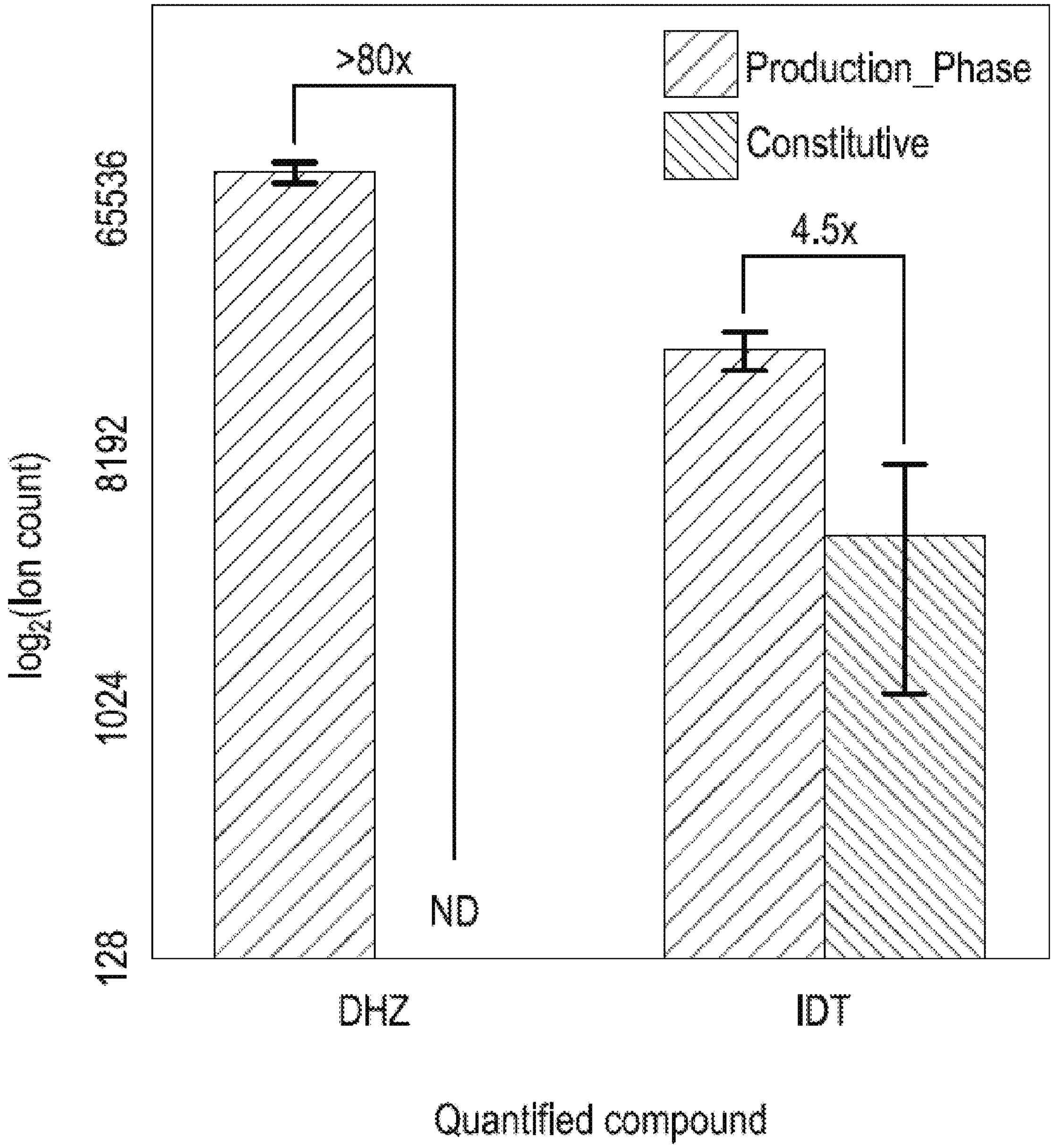
FIG. 26 is a data graph of the production results of two product compounds generated.

Expression of Compound Product Pathways Using the Production-Phase Promoter System To study the utility of the new promoter set for heterologous expression of a biosynthetic system, production of fungal-derived dehydrozearalenol (1) and indole-diterpene (2) was examined (FIG. 24, Compounds 1 & 2). The biosynthesis of the indole-diterpene compound resulted from the coordinated expression of four in *Aspergillus tubingensis* genes (FIG. 25, SEQ ID NOs. 59-62). Two versions of each pathway were constructed: one having all production-phase promoters, and the other having all constitutive promoters (FIG. 24). The production-phase promoter system utilized the pADH2 from *S. cerevisiae* (SEQ ID NO. 1), pADH2 from *S. bayanus* (SEQ ID NO. 38), and pPCK1 (SEQ ID NO. 2) and pMLS1 (SEQ ID NO. 3) from *S. cerevisiae*. In the constitutive system, transcription was driven by four frequently used strong constitutive promoters: pTEF1, pFBA1, pPCK1, and pTPI1 (SEQ ID NOs. 51-54). Each indole-diterpene system was constructed on a single plasmid harboring four expression cassettes: promoter::GGPPS::tADH2; promoter::PT::tPGI1; promoter::FMO::tENO2; and promoter::Cyc::tTEF1; wherein, the promoter sequences corresponded to either the production-phase or the constitutive promoters (FIG. 24). Similar constructs were built for the dehydrozearalenol compound with the two genes HR-PKS and NR-PKS (SEQ ID NOs. 63 and 64). All plasmids were constructed using yeast homologous recombination. It should be noted that pADH2 sequences from *S. cerevisiae* and *S. bayanus* (61% identity) are sufficiently unique for this type of assembly. The production of compounds 1 and 2 produced by *S. cerevisiae* BJ5464/npgA/pRS424 transformed with each of these plasmids were measured over seventy-two hours in YPD batch culture (FIG. 26). An 80-fold and 4.5-fold increase in titer of compound 1 and 2 was observed for the system using the production-phase promoters as compared to the constitutive system.

Materials and Methods Supporting the Production-Phase Promoter Experiments

General techniques, reagents, and strain information: Restriction enzymes were purchased from New England Biolabs (NEB, Ipswich, 25 MA). Cloning was performed in *E. coli* DH5a. PCR steps were performed using Q5® high-fidelity polymerase (NEB). Yeast dropout media was purchased from MP Biomedicals (Santa Ana, CA) and prepared according to manufacturer specifications. Promoter characterization experiments were performed in BY4741 (MATα, his3Δ1 leu2Δ.0 met15Δ.0 ura3Δ0) while all experiments involving the production of 1 were performed in BJ5464-npgA which is BJ5464 (MATaura3-52 his3Δ200 leu2Δ.1 trpl pep4::HIS3 prb1.Δ.1.6R canl GAL) with two copies of pADH2-npgA integrated at & elements. All Gibson assemblies were performed as previously described using 30 bp assembly overhangs.

Construction and characterization of promoter-eGFP reporter strains: All promoters were defined as the shorter of 500 base pairs upstream of a gene's start codon or the entire 5' intergenic region. All promoters from *S. cerevisiae* were amplified from genomic DNA, while ADH2 promoters from all *Saccharomyces* sensu *stricto* were ordered as gBlocks from Integrated DNA Technologies (IDT, Coralville, Iowa). Minimal alterations were made to promoters from *S. kudriavzevii* and *S. mikitae* in order to meet synthesis specifications. In all constructs, eGFP was cloned directly upstream of the terminator from the CYC1 gene (tCYC1). pRS415 was digested with Sacl and Sall and a Notl-eGFP-tCYC1 cassette was inserted by Gibson assembly generating pCH600. Digestion of pCH600 with Accl and Pmll removed the CEN/ARS origin, which was replaced by 500 bp sequences flanking the ho locus using Gibson assembly to yield plasmid pCH600-HOint. Each of the promoters to be analyzed was amplified with appropriate assembly overhangs and inserted into pCH600-HOint digested with Notl to generate the pCH601 plasmid series. Digestion of the pCH601 plasmid series with Ascl generated linear integration cassettes which were transformed into *S. cerevisiae* BY4741 by the LiAc/PEG method. Correct integration was confirmed by PCR amplification of promoters and Sanger sequencing.

For characterization, all strains were initially grown to saturation overnight in 100 μl of YPD media. These cells were then reinoculated at an $OD_{600}$ of 0.1 into 1 ml of fresh YPD and allowed to grow to $OD_{600}$=0.4 to reach mid-log phase growth (approximately 6 hrs). 500 μl of each culture was pelleted by centrifugation and resuspended in YPE broth for YPE data while the remaining 500 μl was used for YPD data. The 0 hour time point was collected immediately after resuspension. For each time point, 10 μl of culture was diluted in 2 ml of DI water and sonicated for three short pulses at 35% output on a Branson Sonifier. Expression data were collected for 10,000 cells using a FACSCalibur flow cytometer (BD Bioscience) with the FL1 detector. Data were analyzed in R using the flowCore package.

Figure 27A:
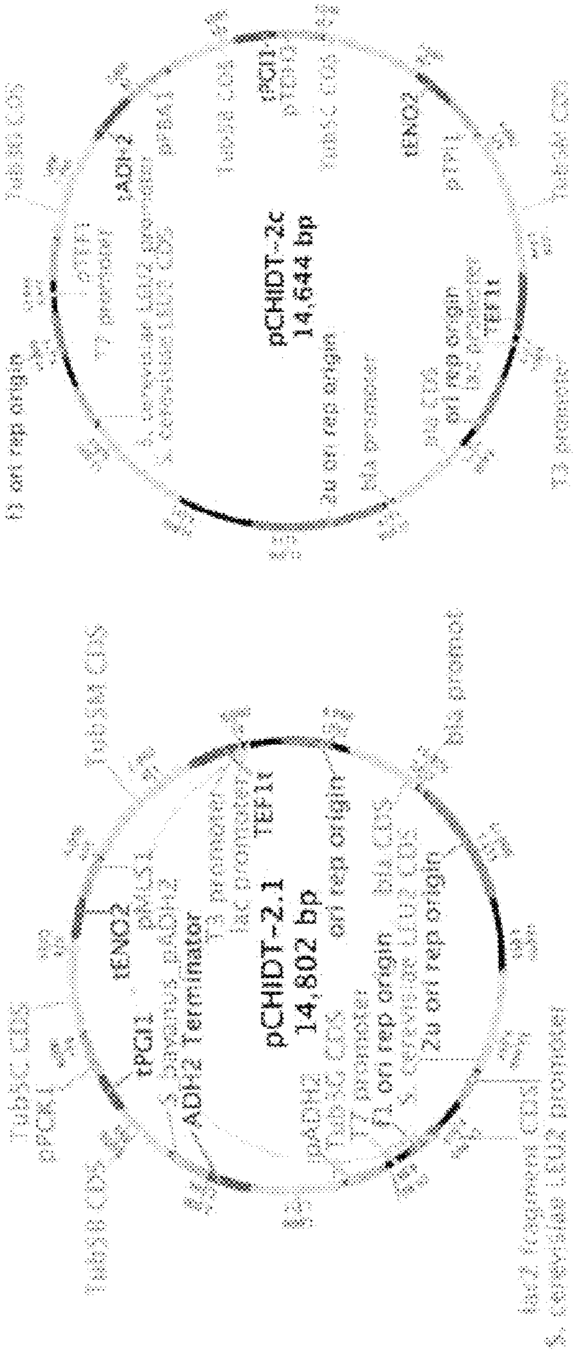
FIG. 27A illustrates two plasmid vector constructs in accordance with an embodiment of the disclosure.

Construction of plasmids to produce compounds in *S. cerevisiae*: The sequences for genes assembled on IDT producing plasmids are contained in the supporting information. Regulatory cassettes of promoters and terminators were fused using overlap extension PCR. All genes and regulatory cassettes were amplified by PCR, ensuring 60 bases of homology between all adjacent fragments. 500 ng of each purified fragment was combined with 100 ng of pRS425 linearized with Not1 and transformed into *S. cerevisiae* BJ5464/npgA. Sixteen clones were picked from each assembly plate and grown to saturation in 5 ml CSM-Leu medium. Plasmids were isolated, transformed into *E. coli* and purified prior to sequence confirmation using the Illumina MiSeq platform. Detailed plasmid maps for pCHIDT-2.1 and pCHIDT-2c are shown in FIG. 27A illustrates the primers used and the assembly strategy (SEQ ID NOs. 65 and 66).

Figure 27B:
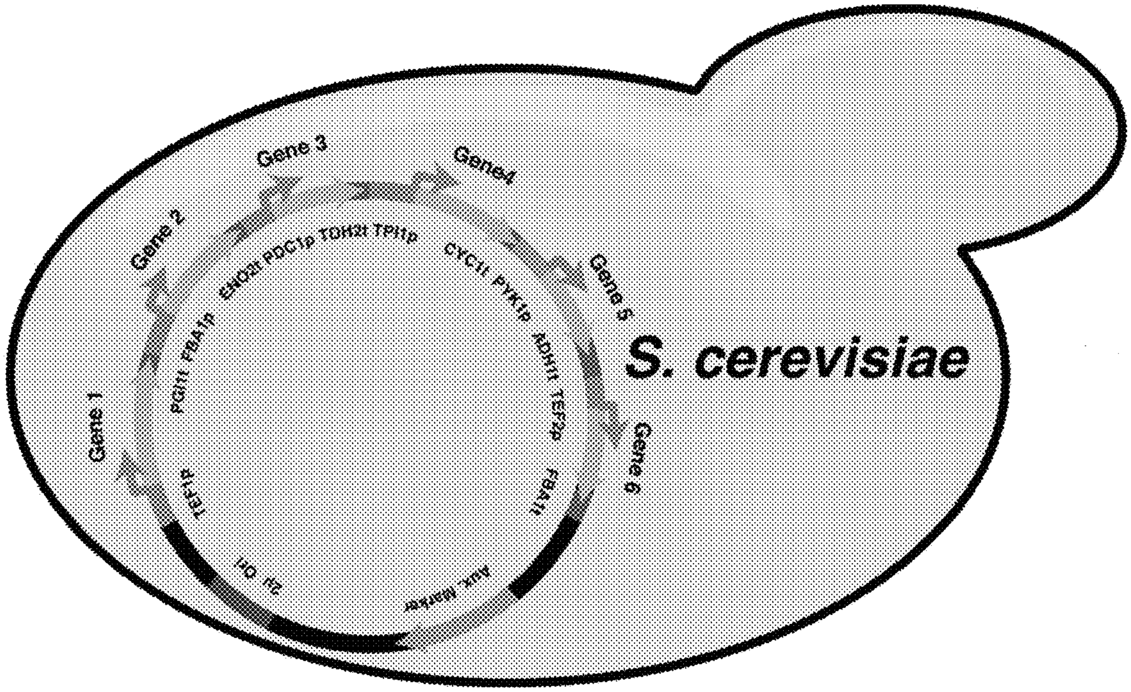
FIG. 27B illustrates a further vector construct in a yeast cell in accordance with an embodiment of the disclosure.

Examining the productivity of indole diterpene generating systems Plasmids pCHIDT-2.1 and pCHIDT-2c were transformed into BJ5464/npgA with pRS424 as a source of tryptophan overproduction (see, e.g., FIG. 27B). Triplicates of each strain were inoculated into CSM-Leu/-Trp medium and grown overnight ($OD_{600}$=2.5-3.0). Each culture was used to inoculate 20 ml cultures in YPD medium at an $OD_{600}$=0.2 and incubated with shaking at 30° C. for 3 days. Every 24 hrs, 2 mls were sampled from each culture. Supernatants were clarified by centrifugation and extracted with 2 ml ethyl acetate (EtOAc). Cell pellets were extracted with 2 ml 50% EtOAc in acetone. 500 μl each of pellet and supernatant extracts were combined and dried in vacuo. Samples were resuspended in 100 μl HPLC grade methanol and LC-MS analysis was conducted on a Shimadzu LC-MS-2020 liquid chromatography mass spectrometer with a Phenomenex Kinetex C18 reverse-phase column (1.7 μm, 100 Å, 100 mm×2.1 mm) with a linear gradient of 15% to 95% acetonitrile (v/v) in water (0.1% formic acid) over 10 min followed by 95% acetonitrile for 7 min at a flow rate of 0.3 mL/min.

Example 2: Identification of Gene Clusters which Produce Compounds that Interact with a Target Protein Thanks to next-generation sequencing, thousands of bacterial and fungal genomes have been sequenced. These species are known to be rich sources of secondary metabolites, for example penicillin, rapamycin, and the statins. These secondary metabolites are small molecules, enzymatically synthesized by the products of one or more genes, often arrayed contiguously in a "biosynthetic gene cluster".

This disclosure describes a method for identifying specific biosynthetic gene clusters, where the target of the secondary metabolite is a specific protein, and expressing that secondary metabolite in a host organism.

In certain cases, for example, when a secondary metabolite is being used as a weapon against other organisms, the secondary metabolite may also be toxic to the organism that produces it. In these cases, the producing organism may defend itself against self-harm in a number of ways: by pumping the secondary metabolite out of the cell; by enzymatically negating the secondary metabolite; or by producing an additional version of the target protein that is less sensitive or insensitive to the secondary metabolite.

In those cases where the organism produces an additional version of the target protein, this "protective" version of the gene is often colocalized with the biosynthetic gene cluster. Although different to the gene that produces the target protein, the protective version should maintain detectable homology to the target protein. This method takes advantage of this homology to identify those biosynthetic gene clusters that contain or are adjacent to a protective homolog of the target protein.

The input data required for this method are a list of biosynthetic gene clusters (e.g., polyketide synthase clusters, non-ribosomal peptide synthetase clusters) and a list of target proteins (i.e., proteins whose activity are to be modulated with secondary metabolites). The biosynthetic clusters may be identified based on the presence of certain protein domains, for example by the software program antiSMASH. The target proteins may be chosen based on their quantitative likelihood of being drug targets.

The output of this method is a score for each biosynthetic cluster, where clusters with higher scores represent those that are more likely to produce secondary metabolites targeting specific proteins of interest.

A score was constructed for each biosynthetic cluster based on the following factors:

1. the presence of one or more homologs of a target protein within or adjacent to the cluster, as determined by a homology search (e.g., using the tblastn algorithm, with a maximum score granted when one homolog is found)
2. the confidence in homology of the target to genes in a cluster (e.g., according to the tblastn algorithm, with an increasing score for lower e-values, and an upper bound threshold of 1e-30)
3. the fraction of the homologous gene that meets a certain threshold of identity (e.g., with an increasing score for more identity, and a lower bound threshold of 25% identity)
4. the total number of genes homologous to the target protein present in the entire genome of the organism (e.g., with a maximum score granted to cases with 2-4 homologs per genome)
5. the homology of the gene in or adjacent to the cluster to the target protein (e.g., using the blastx algorithm, with a maximum score granted when the gene in the biosynthetic gene cluster's closest homolog in the target protein's genome is the target protein itself)
6. the phylogenetic relationship of the target protein to the gene in the cluster (e.g., with an increasing score for homologs in the gene cluster that clade with the target protein, with confidence assigned by a bootstrap test or Bayesian inference of phylogeny, and a lower bound threshold defined as homologs in a phylogenetic context that appear in a clade with bootstrap value of 0.7 or Bayesian posterior probability of 0.8)
7. the expected number of homologs of the target in or adjacent to the biosynthetic cluster (e.g., with a greater score the lower the probability of a homolog of the target being present in or adjacent to a biosynthetic cluster of a certain size, given the number of total homologs in the genome, as determined by a permutation test)
8. the likelihood that the target protein is essential for viability, growth, or other cellular processes in the native environment, e.g., through evidence that deletion of homologs in related organisms (such as *S. cerevisiae*) render the organism inviable 9. synteny of the gene cluster with related species (e.g., with a maximum score if the entire cluster, including the target homolog, is conserved across several species)
10. the functional class of the target homolog (e.g., with a greater score if the gene is in a protein complex already known to be targeted by secondary metabolites)
11. the presence of specific promoters adjacent to the target homolog (e.g., with a greater score when there is a bidirectional promoter upstream of the target homolog and a biosynthetic gene)
12. the presence of specific regulatory elements in the biosynthetic gene cluster (e.g., with a greater score when there is a transcription factor binding site that is shared between target genes and/or biosynthetic genes in the cluster)
13. the presence of target homologs outside the cluster (including on other chromosomes) that are co-regulated with some or all of the genes in the biosynthetic cluster (e.g., with a greater score when biosynthetic gene clusters are co-regulated with putative target homologs)
14. the presence of protein- and DNA-sequence-derived features within the clusters that have successfully been shown to produce secondary metabolites (e.g., with a greater score when a gene in a cluster shares a domain—as determined by a Hidden Markov Model (HMM)—with a cluster that has produced a secondary metabolite in one of the host organisms)

The above score was calibrated with reference to a set of "true positives" (i.e., cases where there are one or more known targets in or adjacent to a biosynthetic gene cluster that produces a small molecule known to target that protein).

This algorithm has been programmed in the Python programming language and has been applied to a set of more than 1,000 fungal genomes (and more than 10,000 biosynthetic gene clusters) to produce a list of potentially relevant biosynthetic clusters.

Expressing Biosynthetic Clusters in a Host Organism

Given the highest scoring biosynthetic clusters as defined by the algorithm above, DNA was synthesized for each of the genes in those clusters. The DNA was cloned into a host organism (e.g., *S. cerevisiae*, also known as baker's yeast) for expression. The host organism synthesized the proteins from the gene cluster, which produces a secondary metabolite. Using HPLC and mass spectrometry, the secondary metabolite-expressing strain can be compared to an unmodified strain and affirm the presence of a new secondary metabolite.

This method has been successfully applied to the production of several secondary metabolites where there is evidence, based on the above method, for what the target protein of the secondary metabolite should be:

An secondary metabolite derived from a biosynthetic gene cluster containing a homolog of the human gene SOS1;

An secondary metabolite derived from a biosynthetic gene cluster containing a homolog of the human gene BRSK1; and An secondary metabolite derived from a biosynthetic gene cluster containing a homolog of the human gene DDX41.

A further example of a gene cluster which produces a product, for which there is evidence suggesting the target, is shown in FIG. 15A.

Example 3: Prioritization of Novel Biosynthetic Gene Clusters by Phylogenetic Analysis Two classes of fungal BGCs; those with either a polyketide synthase (PKS), or an UbiA-type sesquiterpene cyclase (UTC) as their core enzyme were chosen for analysis.

Figure 28A:
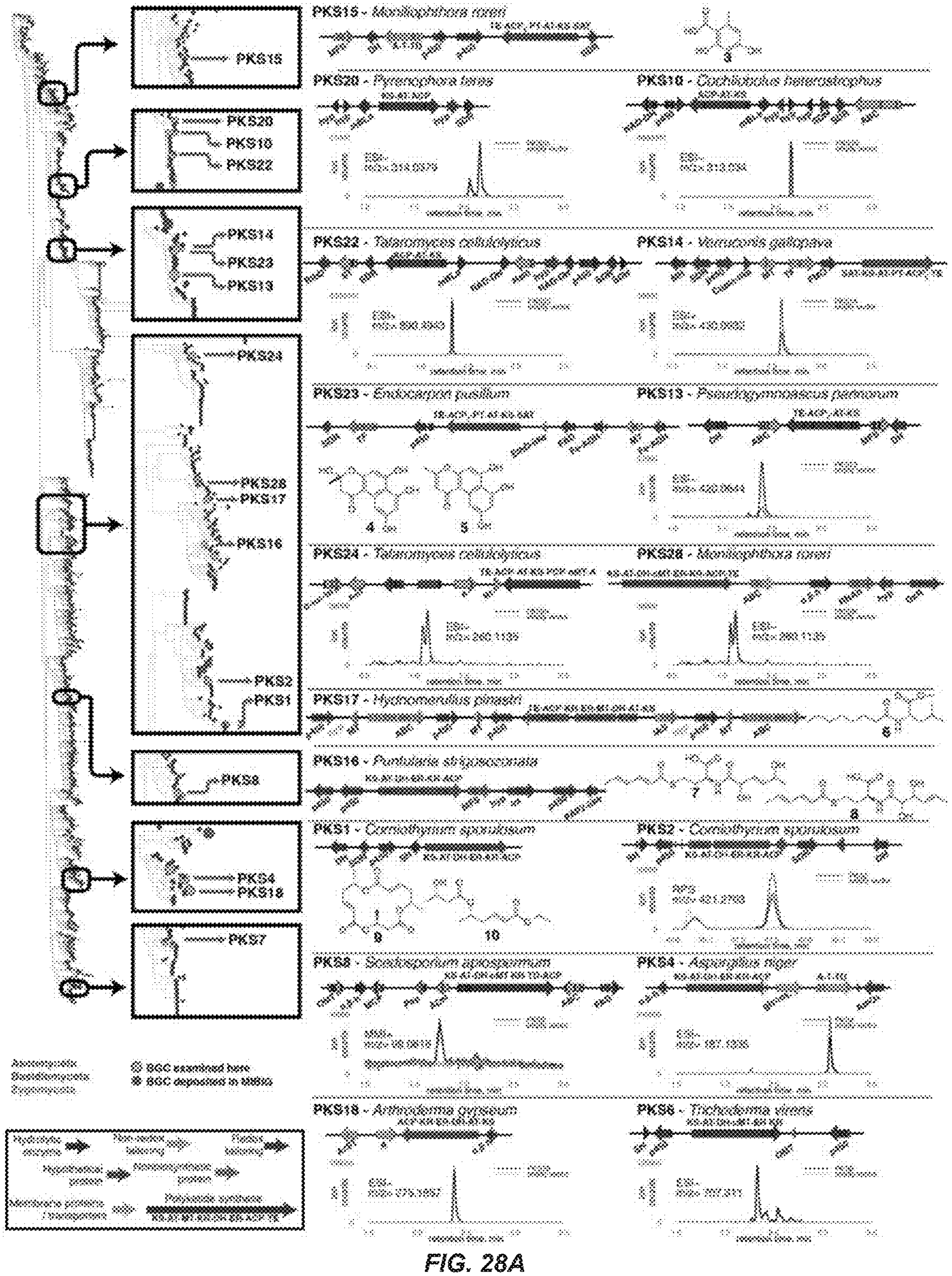
FIG. 28A illustrates a phylogenetic analysis of further gene clusters. Abbreviations used may include Adenylation domain (A), a,b-hydrolase (a,b-h), ATP-binding cassette transporter (ABC), Acyl carrier protein (ACP), Alcohol dehydrogenase (ADH), Aldo-keto reductase (AK-red), Aminooxidase (AmOx), Aminotransferase (AmT), Arylsulfotransferase (ArST), Acyltransferase domain (AT), C-methyltransferase (cMT), Terpene cyclase (Cyc), Dehydratase (DH), Domain of unknown function 4246 (DUF4246), Flavin adenine dinucleotide (FAD) binding protein (FAD), Iron dependent alcohol dehydrogenase (Fe-ADH), Flavin-dependent monooxygenase (FMO), Geranyl-geranyl pyrophosphate synthase (GGPPS), Glycosidase (glycos.), Glucose-methanol-choline oxidoreductase (GMC), Halogenase (Halo), Highly reducing polyketide synthase (HR-PKS), Hypothetical protein (Hyp), Indole-3-acetic acid-amido synthetase (IAS), Ketosynthase domain (KS), metallo-B-lactamase (mBla), Mitochodrial phosphate carrier protein (MCP), Major facilitator superfamily transporter (MFS), Metallohydrolase (MH), Methyl transferase (MT), Nicotine adenine dinucleotide dependent dehydrogenase (NAD-DH), Nicotine adenine dinucleotide phosphate (NADP) dependent reductase (NADP-R), N-mehtyltransferase (nMT), Non reducing polyketide synthase (NR-PKS), O-succinylhomoserine sulfhydrylase (O-suc-SH), O-methyltransferase (oMT), Oxidoreductase (OxR), Cytochrome p450 (p450), Dipeptidyl peptidase (Pep), Prenyl transferase (PrT), Product template domain (PT), Riboflavin biosynthesis protein RibD (RibD), RNA helicase (RNAh), starter unit:ACP transacylase domain (SAT), Short-chain dehydrogenase (SDH), Short-chain dehydrogenase/reductase (SDR), Serine hydrolase (SH), Sugar transport protein (ST), Thiolation domain (T), Terminal domain (TD), Thioesterase domain (TE), Transcription factor (TF), and UbiA-type terpene cyclase (UTC).
Figure 28B:
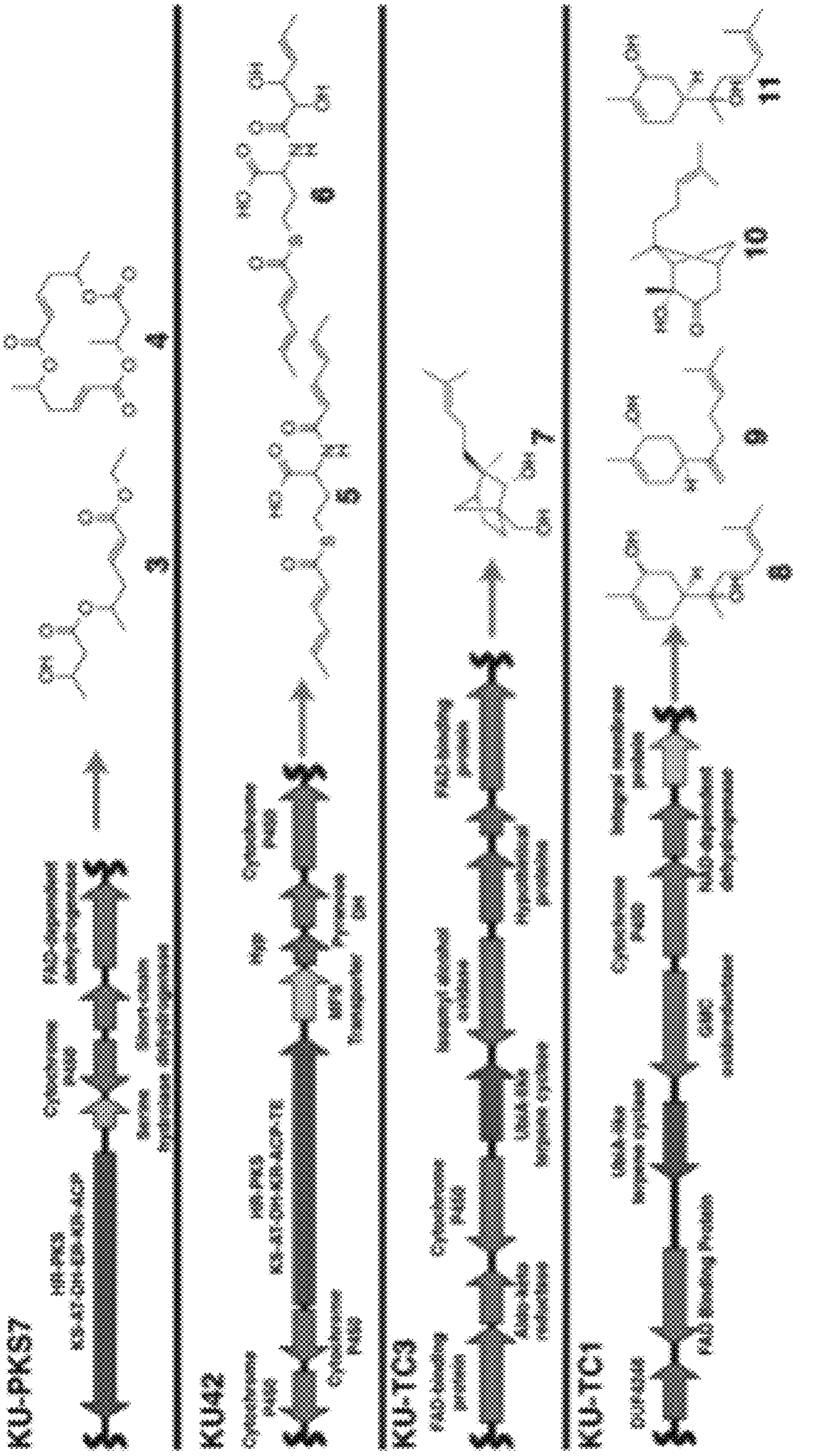
FIG. 28B illustrates various gene clusters and biosynthetic compound products in accordance with various embodiments of the invention.
Figure 28C:
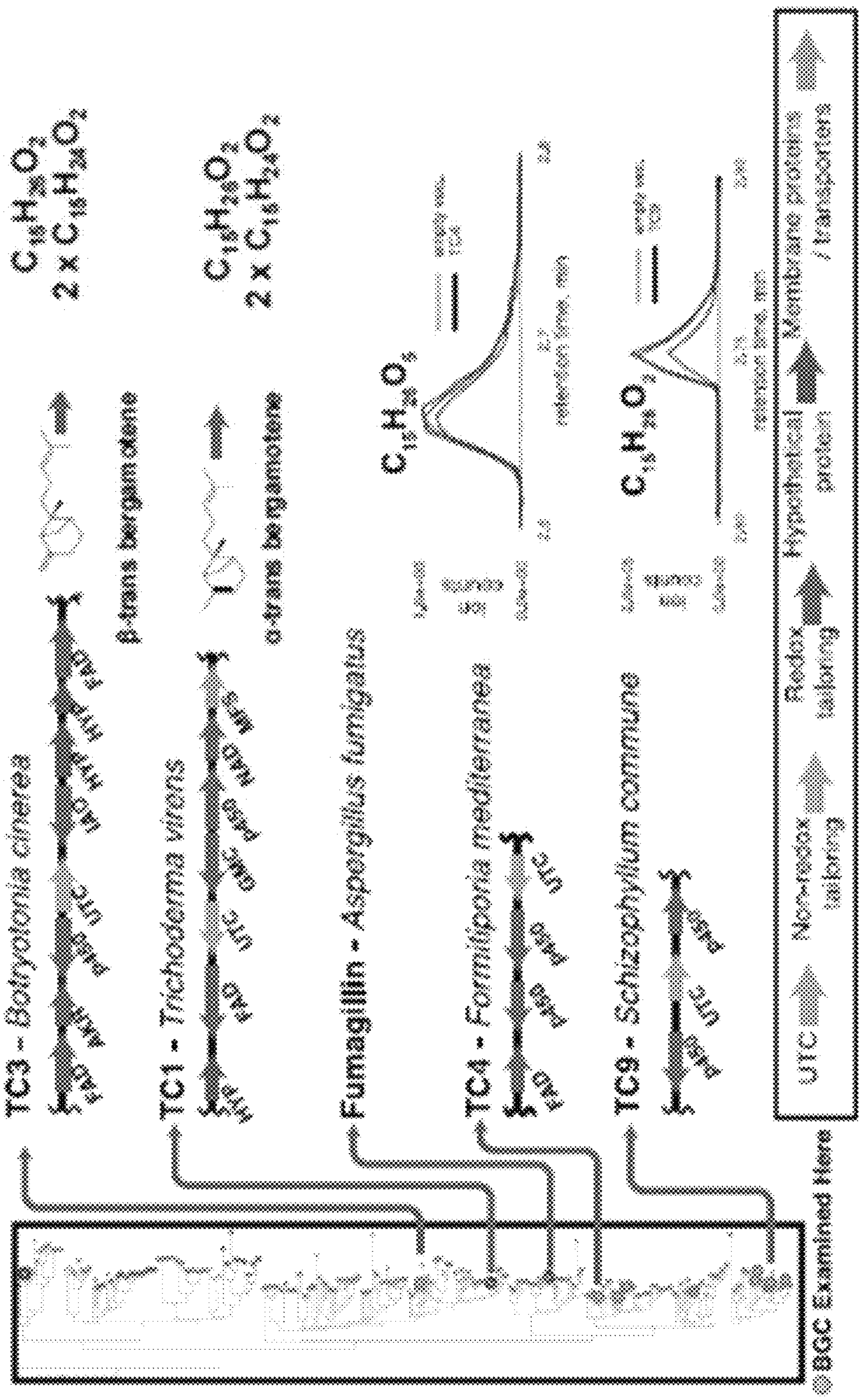
FIG. 28C illustrates various gene clusters and biosynthetic compound products in accordance with various embodiments of the invention.
Figure 28D:
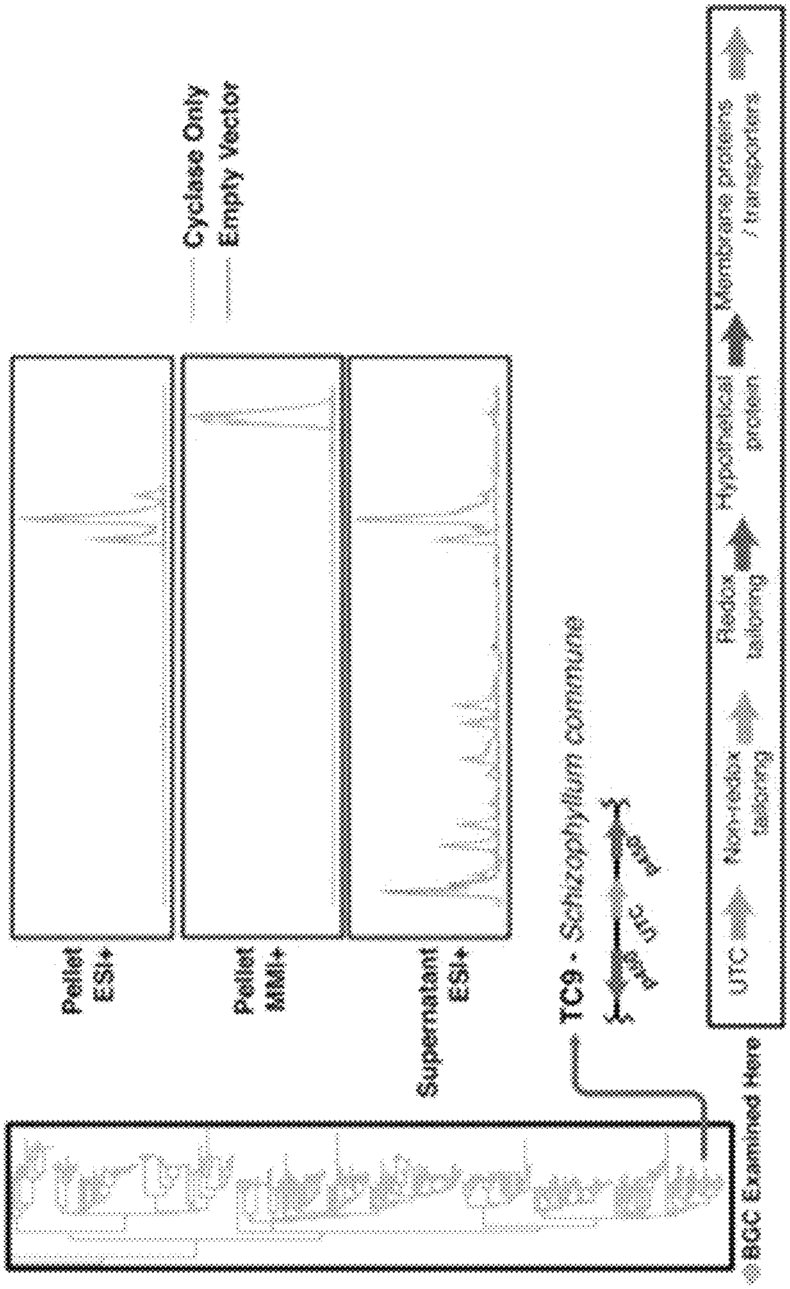
FIG. 28D illustrates various gene clusters and biosynthetic compound products in accordance with various embodiments of the invention.
Figure 28E:
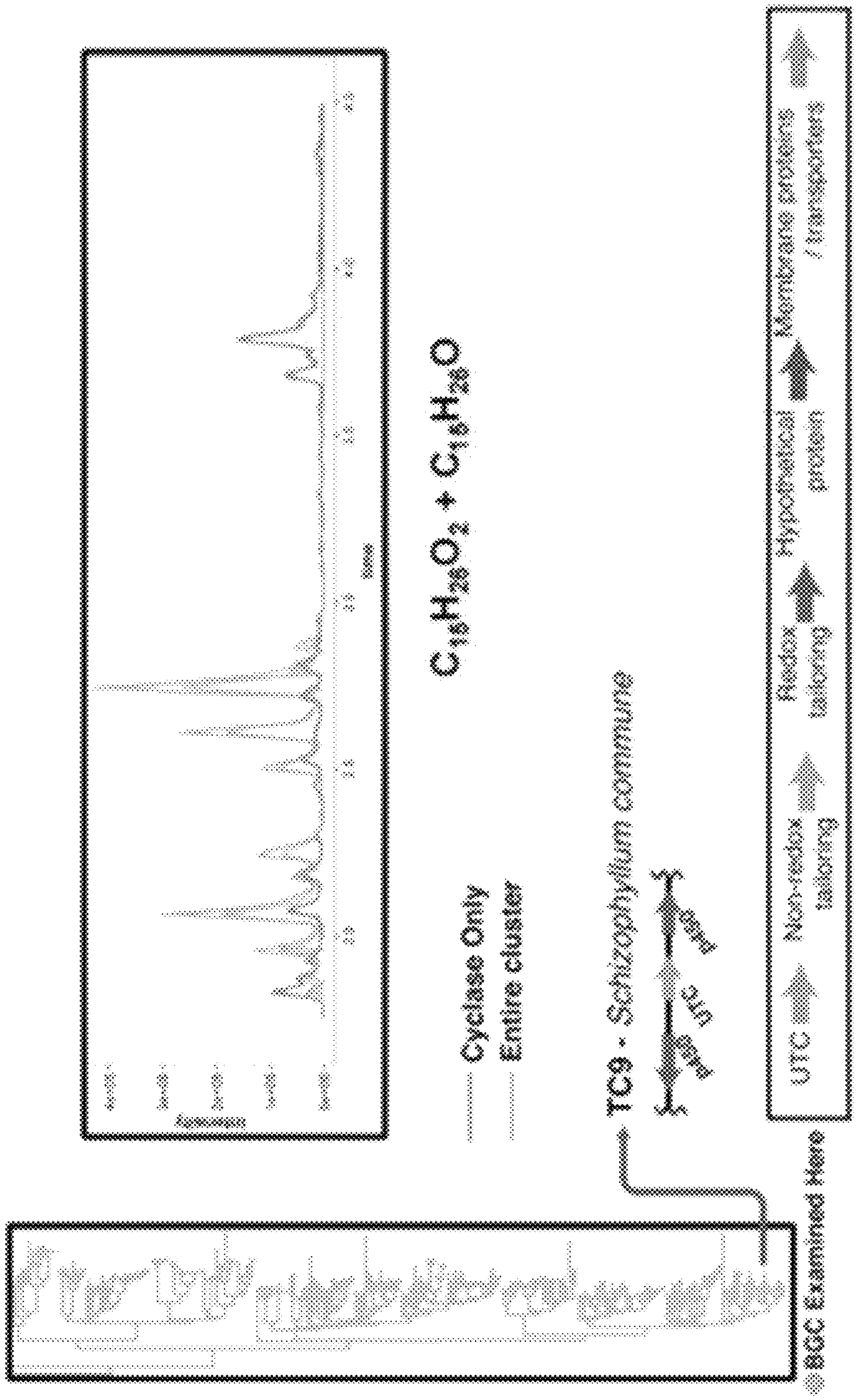
FIG. 28E illustrates various gene clusters and biosynthetic compound products in accordance with various embodiments of the invention.
Figure 28F:
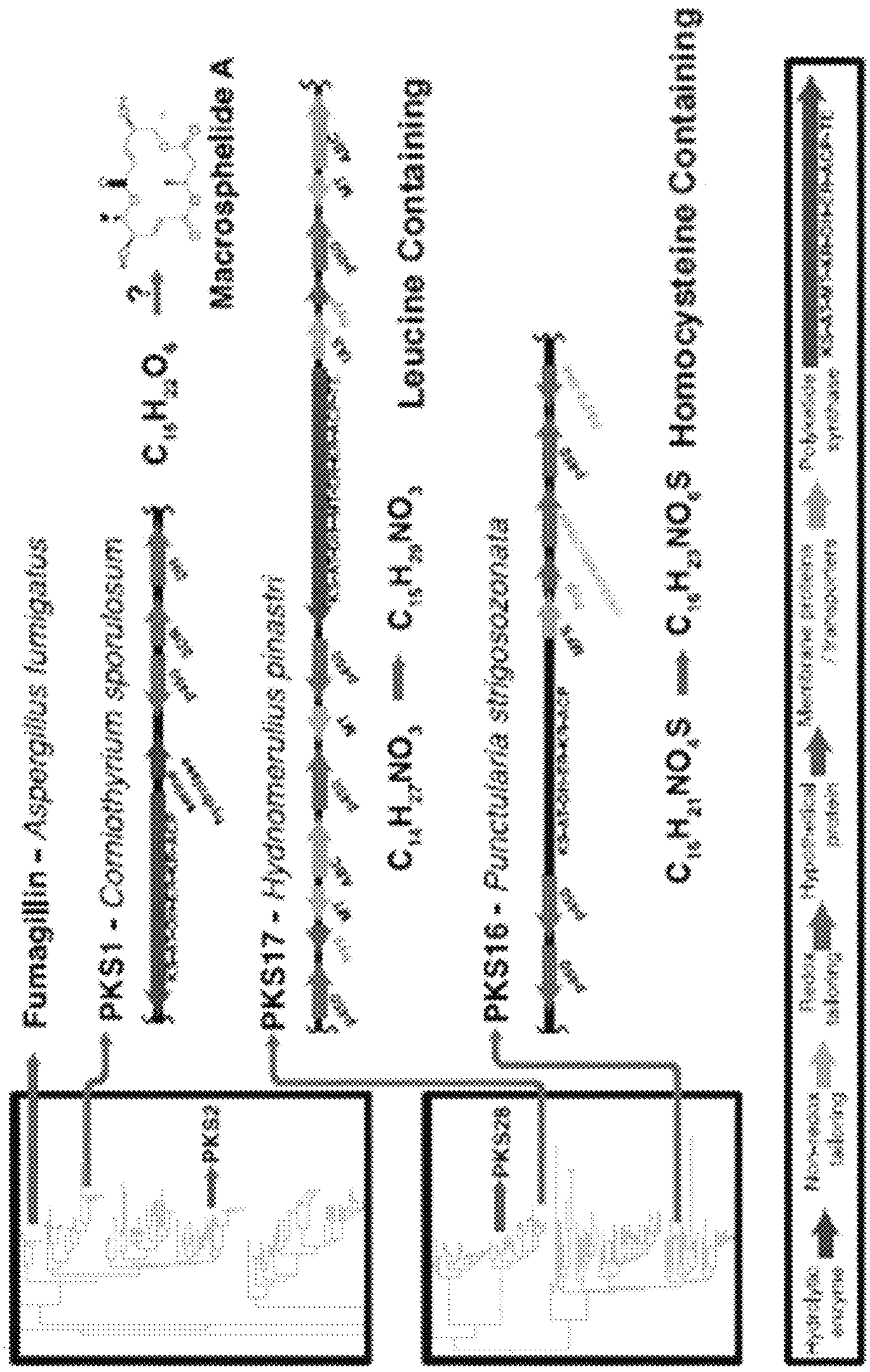
FIG. 28F illustrates various gene clusters and biosynthetic compound products in accordance with various embodiments of the invention.
Figure 29A:
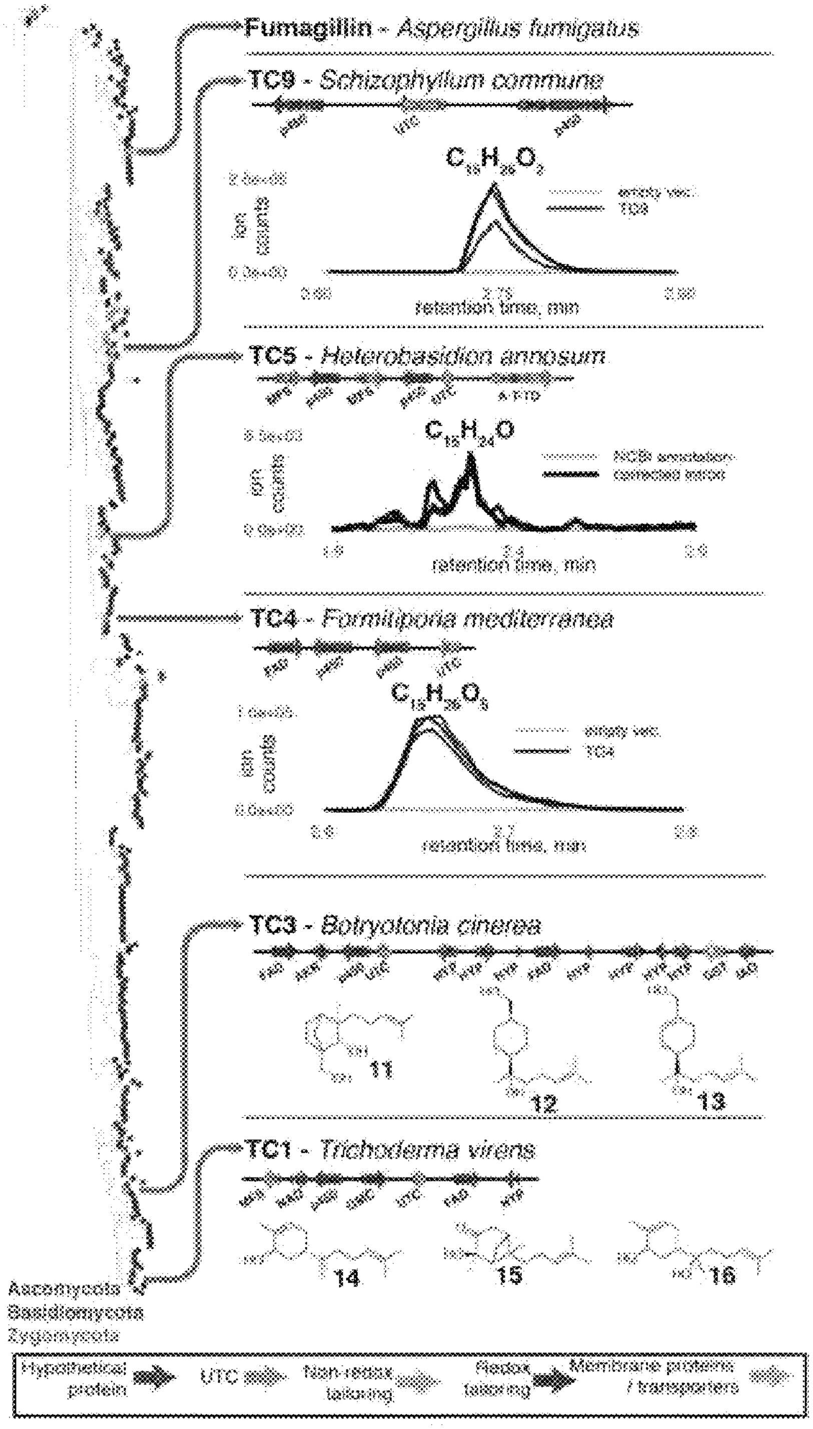
FIG. 29A illustrates a phylogenetic analysis of gene clusters.

A computational pipeline was developed to prioritize PKS and UTC containing BGCs for heterologous expression. 581 sequenced fungal genomes were analyzed from the publicly available GenBank database of the National Center for Biotechnology Information (NCBI, as of July 2015). Each genome was analyzed for BGCs using antiSMASH2, identifying 3512 BGCs harboring an iterative type 1 PKS (iPKS) and 326 BGCs harboring a UTC homologue. Phylogenetic trees of each of these enzyme types were generated with identified characterized homologs from the MIBiG database20. BGCs were primarily selected from clades having few characterized members (FIG. 28A, FIG. 29A). The selected BGCs were found in the genomes of both ascomycetes and basidiomycetes. Basidiomycetes are, in general, more difficult to culture with fewer tools for genetic manipulation available as compared to ascomycetes. As a result, BGCs from basidiomycetes are under-studied, with few PKS-containing clusters deposited in MIBig, suggesting that these organisms represent a reservoir of BGCs capable of producing compounds with interesting new structures.

The coding sequences of all BGCs were ordered as synthetic constructs according to the default predicted gene coordinates (start, stop, and introns) as deposited in GenBank and clusters are described in Table 4.

Figure 30A:
FIG. 30A illustrates schematics of PKS enzyme containing BGCs examined herein.

Shown in FIG. 28A is a cladogram of the ketosynthase sequences of the 3512 iPKS sequences identified in this study. Of these, 28 were selected and the associated BGC containing the selected iPKS was analyzed using heterologous expression. Selected BGCs met the following criteria: (a) genetic structure was conserved across 3 or more species, (b) exhibited canonical domain architecture, and (c) contained an in-cis or proximal in-trans protein capable of releasing the polyketide from the carrier protein of the PKS (FIG. 30A). Seven of these clusters were derived from distinct clades comprised entirely of sequences from basidiomycetes (FIG. 28A).

The 28 selected PKS clusters were edited according to the methods described here to form expression vectors suitable for expression of the cluster coding sequences in yeast cells. The host cells were incubated and analyzed for the presence of novel chemical compounds by HPLC, as described in the methods section below. Of the PKS clusters selected from ascomycetes, 13 produce compounds. The most notable is the PKS1 cluster, which only contains an iPKS, a hydrolase, and the genes for three tailoring enzymes: a Cytochrome p450 (P450), a Flavin-dependent monooxygenase (FMO), and a Short-chain dehydrogenase/reductase (SDR).

Figure 30B:
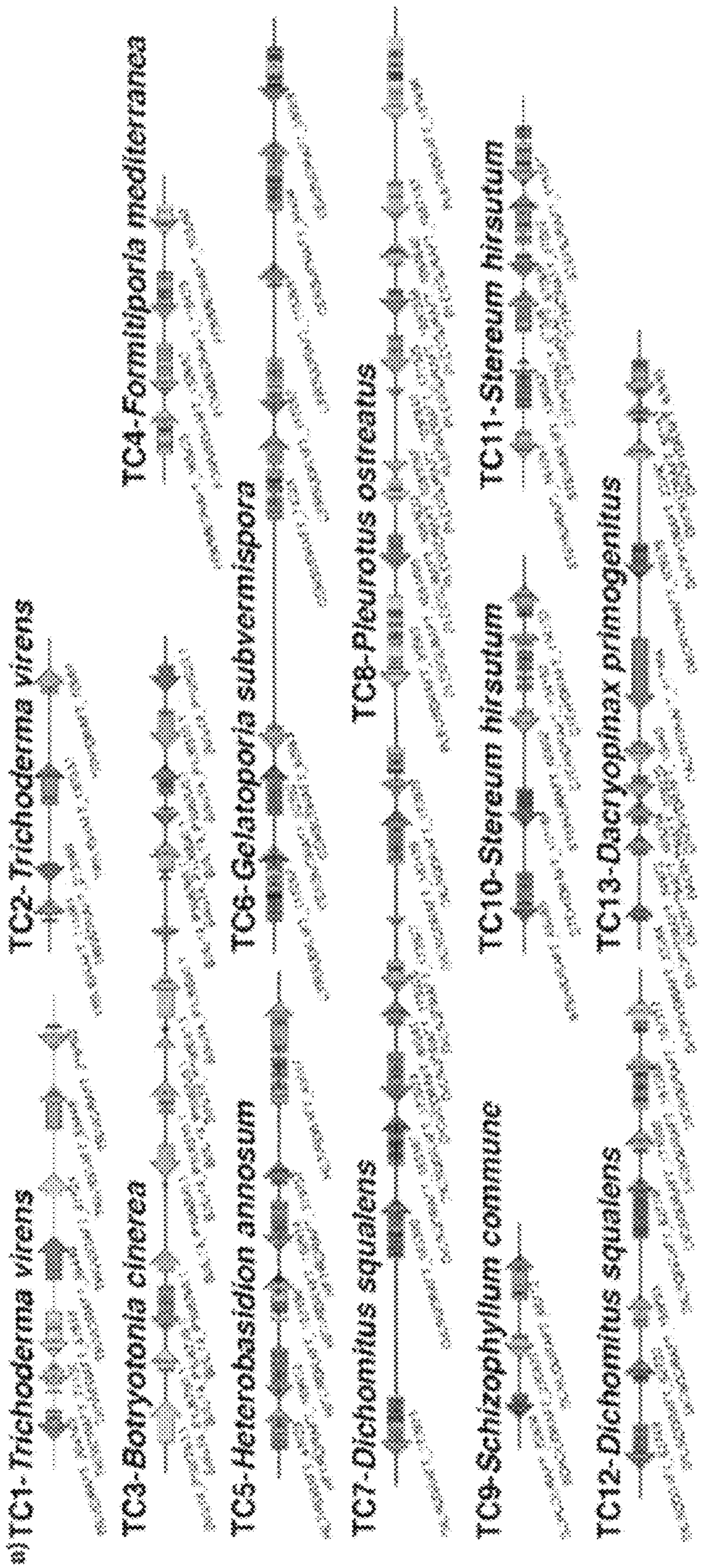
FIG. 30B illustrates schematics of UTC containing BGCs examined herein.

For the study of fungal UTCs, the phylogenetic tree shown in FIG. 29A was constructed based on the UbiA-type sesquiterpene cyclase, Fma-TC, from the fumagillin biosynthetic pathway. Moreover, the P450, Fma-P450, from the same pathway was shown to be a powerful enzyme catalyzing the 8 e oxidation of bergamotene to generate a highly oxygenated product. UTC BGCs spanning the entirety of the cladogram were selected in FIG. 29A where a cytochrome P450 was proximal to the UTC gene (FIG. 30B). Ultimately, 13 UTC BGCs from both ascomycetes and basidiomycetes were selected for analysis.

Screening of strains expressing these clusters by LC/HRMS revealed novel spectral features consistent with oxidized sesquiterpenoids being produced by five clusters (FIG. 29A). These results demonstrate that the membrane-bound UTCs represent a general class of terpene cyclase encoded by the genomes of diverse fungi. Several clusters and compounds produced are shown in FIGS. 28B, 28C, 28D, 28E and 28F.

Figure 29B:
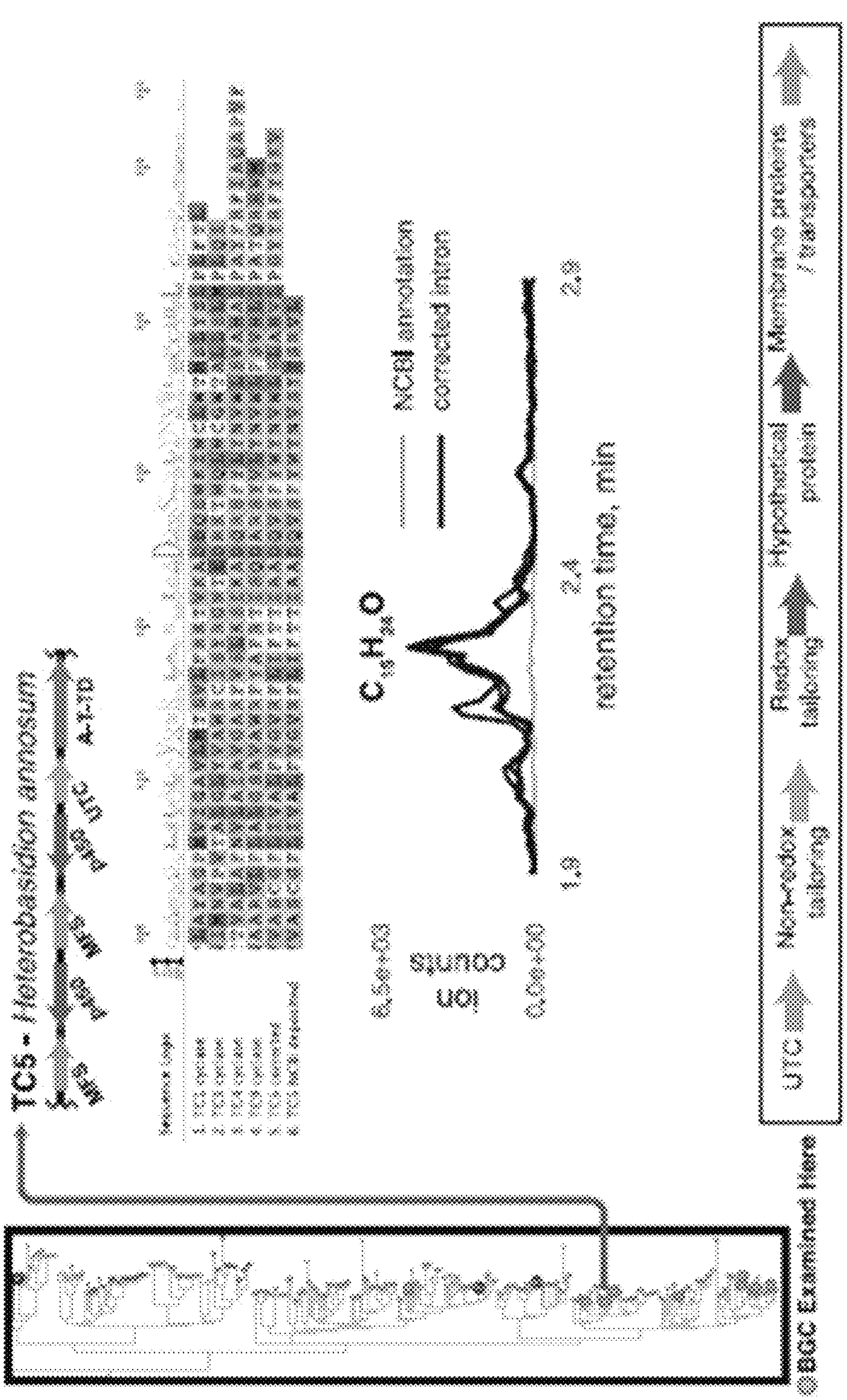
FIG. 29B illustrates correction of a gene cluster. SEQ ID Nos. 484-489.

Including both PKS and UTC BGCs, 24 of the 41 clusters produced measurable compounds, see Table 4 for a summary of the type, species of origin, and productivity of the clusters. Gene annotation errors introduced by incorrect intron prediction may have contributed to this failure rate. Manual inspection of one UTC (TC5) that initially had yielded no products suggested an incorrect intron prediction at the 5' terminus of the gene. Correction of this intron led to a C-terminal protein sequence that aligned well with known functional UTCs. When tested by heterologous expression in a host cell, the version with the corrected intron produced a compound confirming that incorrect intron prediction is a failure mode in approaches that rely on publicly available gene annotations, (FIG. 29B). These results illustrate the importance of careful gene curation and the need for improved eukaryotic gene prediction, particularly with sequences from taxa with few well-studied members.

The results summarized in Table 4 demonstrate the utility of the methods herein for the selection of cryptic fungal BGCs. With the tools developed here, strains were built expressing 41 such clusters with 22 (54%) producing detectable levels of products not native to *S. cerevisiae*. While both basidiomycetes and ascomycetes are known to be prolific producers of bioactive compounds, to date, the bulk of research on the biosynthesis of fungal natural products has been undertaken in ascomycetes. In this study, heterologous expression allowed a large-scale survey of cryptic fungal BGCs from both ascomycetes and basidiomycetes, a less studied and more difficult to culture division of fungi with fewer tools for genetic manipulation. Using this platform, a panel of new products produced by the selected PKS and UTC clusters was identified.

Methods antiSMASH2 software was applied to 581 public fungal genomes deposited in the Genbank database of the National Center for Biotechnology Information (NCBI), to search for type 1 PKS and UbiA-like terpene cyclase gene clusters. This analysis identified 3,512 type 1 PKS gene clusters and 326 UbiA-like terpene gene clusters in 538 fungal genomes.

Phylogenetic analysis of both sequence sets was performed by building multiple sequence alignments of all protein sequences using MAFFT and building phylogenetic trees as shown in FIG. 28A and FIG. 29A using FastTree 2.

28 of the 3,512 sequenced type 1 PKS gene clusters and 13 of the 326 terpene gene clusters were selected for expression in yeast as described above.

Construction and Culture of Production Strains:

Production strains were constructed by transforming plasmid DNA isolated out of *E. coli* (Qiagen miniprep 27106) into the appropriate expression host (JHY692 for PKS containing plasmids, JHY705 for all others) using the Frozen-EZ Yeast Transformation II kit (Zymo Research T2001) followed by plating on the appropriate SDC dropout media (CSM-Leu for PKS containing plasmids, CSM-Ura for all others). For BGCs encoded on at least two plasmids, three biological replicates for each haploid transformant were mated on YPD plates and incubated at 30° C. for 4-16 hrs prior to streaking for single colonies on CSM-Ura/-Leu and incubated at 30° C.

Small-scale cultures for analysis were begun by picking three biological replicates of each production strain along with empty vector controls into 500 μL of the appropriate SDC dropout medium in a 1 ml deep-well block and grown for approximately 24 hrs at 30° C. 50 μL of overnight culture was used to inoculate 500 μL of each of the production media to be tested in the experiment (generally both YPD and YPEG) in 1 ml deep well blocks. All blocks were covered with gas-permeable plate seals (Thermo Scientific AB-0718) and incubated at 30° C. for 72 hrs with shaking at 1000 rpm. Supernatants were clarified by centrifugation for 20 mins at 2800 g and a minimum of 100 μl of clarified supernatant was stored for future analysis. The remainder of the supernatant was discarded and the cell pellets extracted by mixing with 400 μL of 1:1 ethyl acetate: acetone. Cell debris was precipitated by centrifugation for 20 mins at 2800 g and 200 μL of the extraction solvent pipetted to a fresh block and evaporated in a speedvac.

Prior to analysis, all supernatants were passed through a 0.2 μm filter plate while all cell pellet extracts were resuspended in 200 μl of HPLC grade methanol prior to filtering.

Analysis of Small Scale Cultures:

LC-MS analysis was conducted on an Agilent 6545 quantitative time-of-flight mass spectrometer interfaced to an Agilent 1290 HPLC system. The ion source for most analyses was an 72 electrospray ionization source (dual-inlet Agilent Jet Stream or "dual AJS"). In some analyses, an Agilent Multimode Ion Source was also used for atmospheric pressure chemical ionization. The parameters used for both ionization sources are outlined in Table 5.

The HPLC column for all analyses was a 50 mm×2.1 mm Zorbax RRHD Eclipse C18 column with 1.8 μm beads (Agilent, 959757-902). No guard column was used.

Gradient conditions were isocratic at 95% A from 0 to 0.2 min, with a gradient from 95% A to 5% A from 0.2 to 4.2 minutes, followed by isocratic conditions at 5% A from 4.2 to 5.2 minutes, followed by a gradient from 5% A to 95% A from 5.2 to 5.2 minutes, followed by isocratic re-equilibration at 95% A from 5.2 to 6 minutes. For electrospray analyses, A was 0.1% v/v formic acid in water and B was 0.1% v/v formic acid in acetonitrile. For APCI analyses, B was substituted by 0.1% v/v formic acid in methanol.

Figure 31:
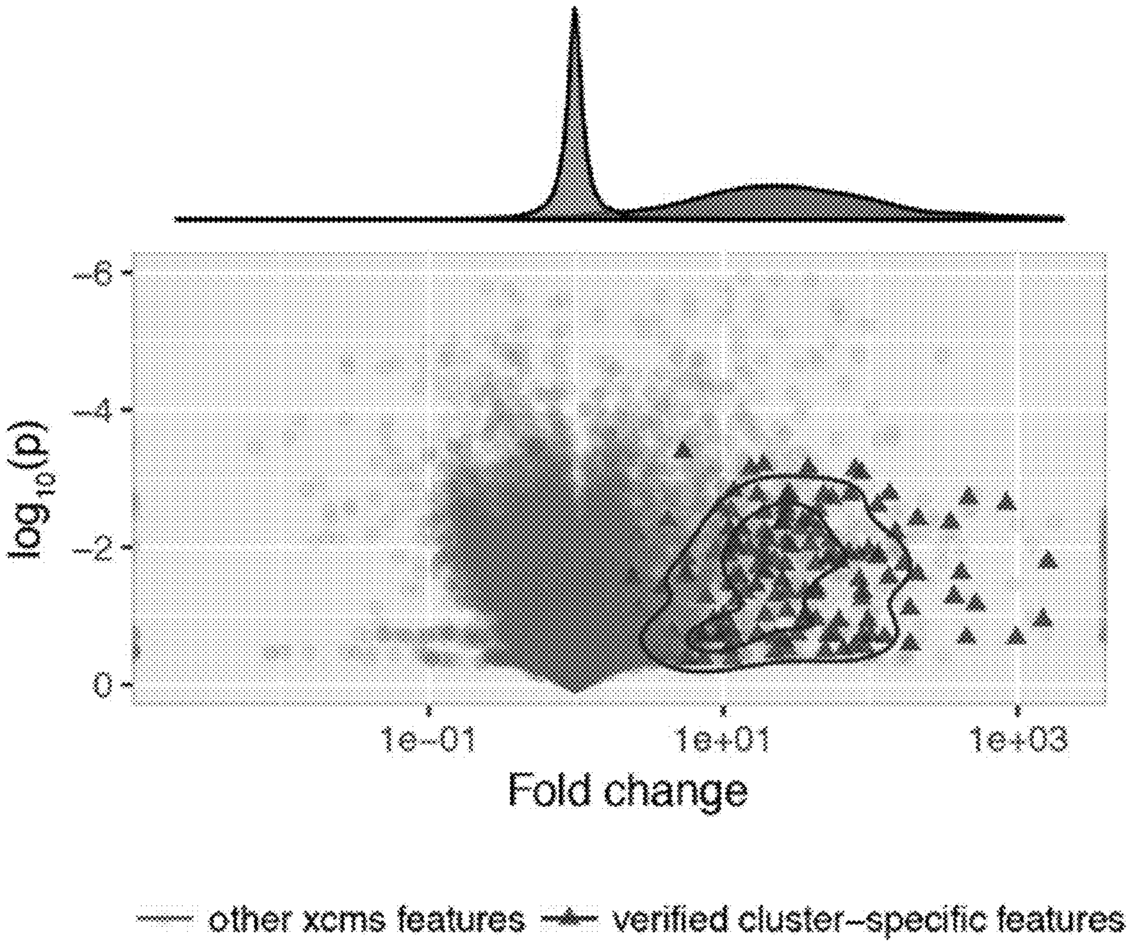
FIG. 31 illustrates a volcano plot of all spectral features identified in the automated analysis of strains expressing PKS containing BGCs. All features determined to be specific to the BGC expressing strain were identified by comparison to a negative vector control.
Figure 32:
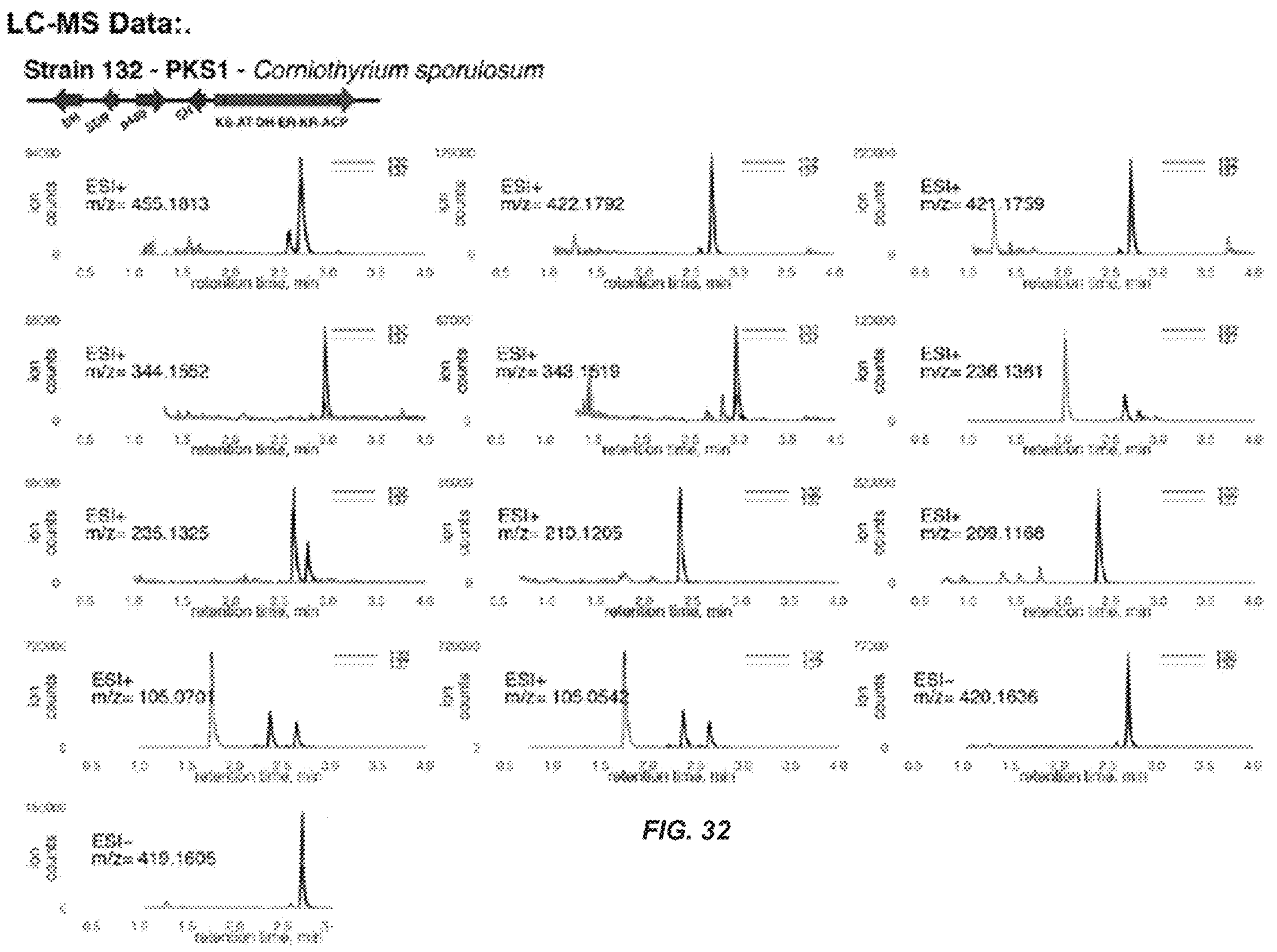
FIG. 32 illustrates features produced by BGC PKS1.
Figure 33:
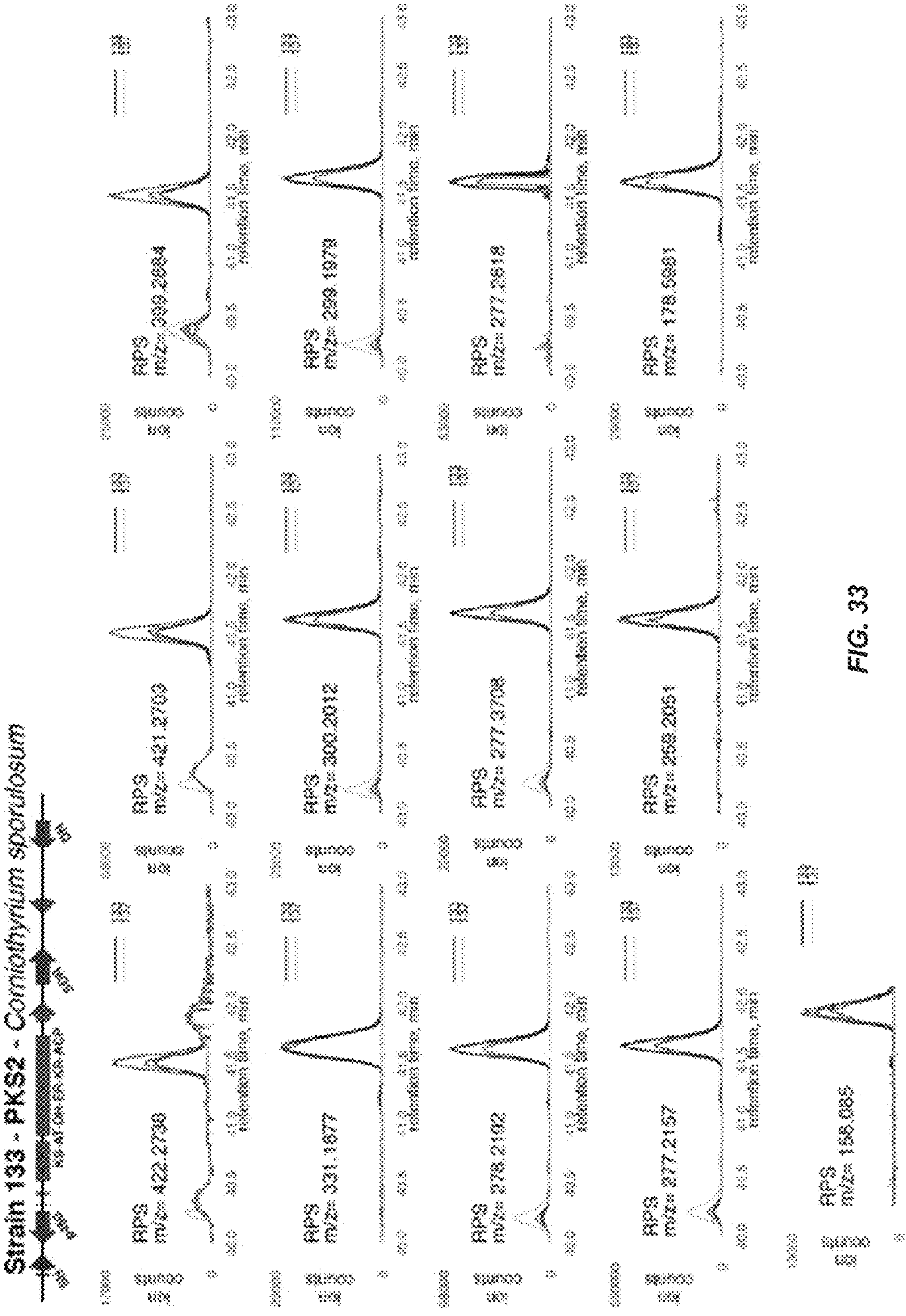
FIG. 33 illustrates features produced by BGC PKS2.
Figure 34:
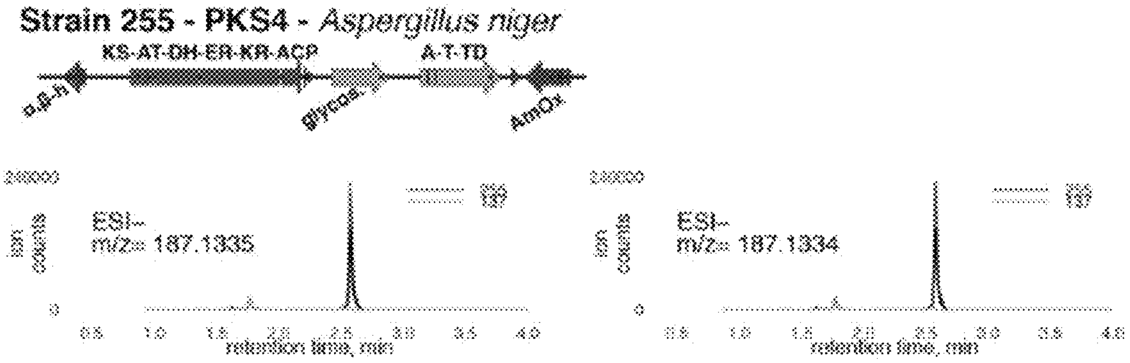
FIG. 34 illustrates features produced by BGC PKS4.
Figure 35:
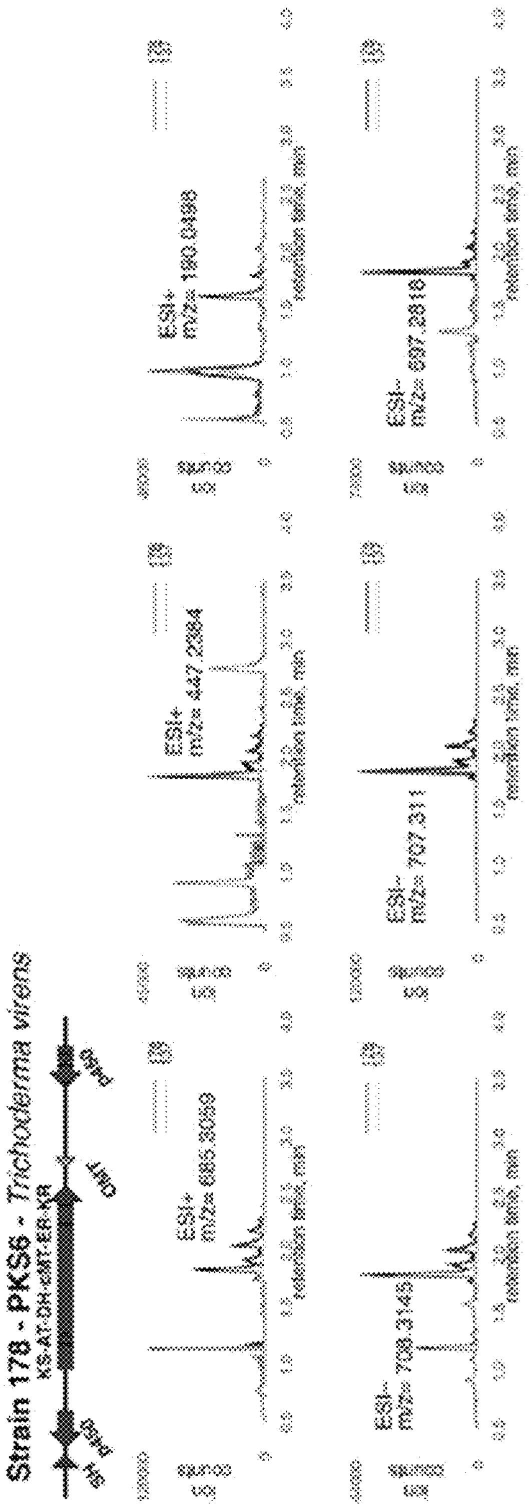
FIG. 35 illustrates features produced by BGC PKS6.
Figure 36:
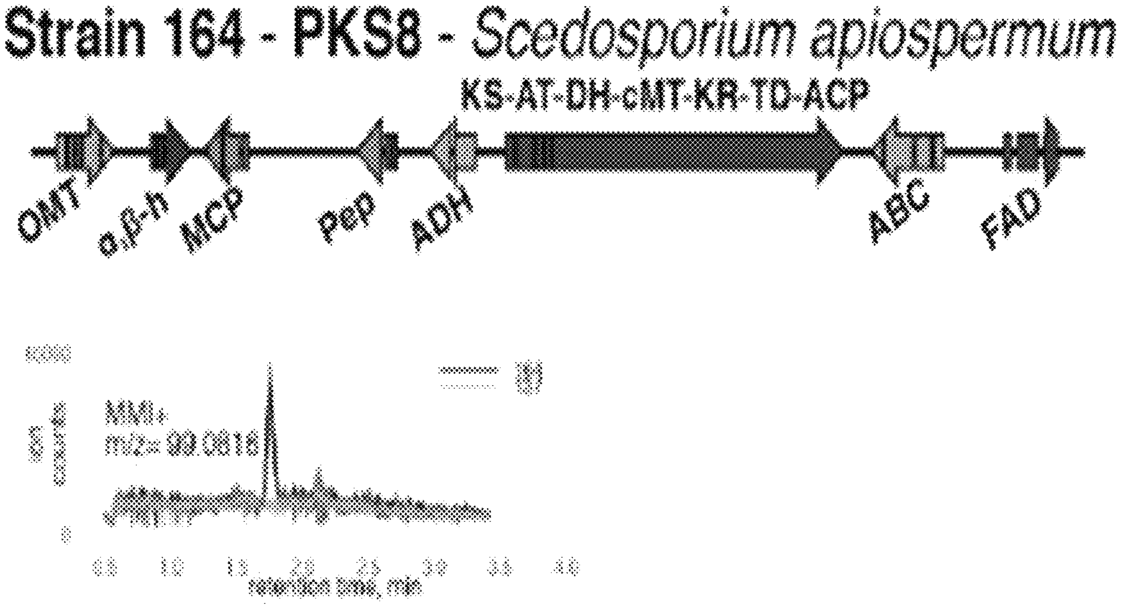
FIG. 36 illustrates features produced by BGC PKS8.
Figure 37:
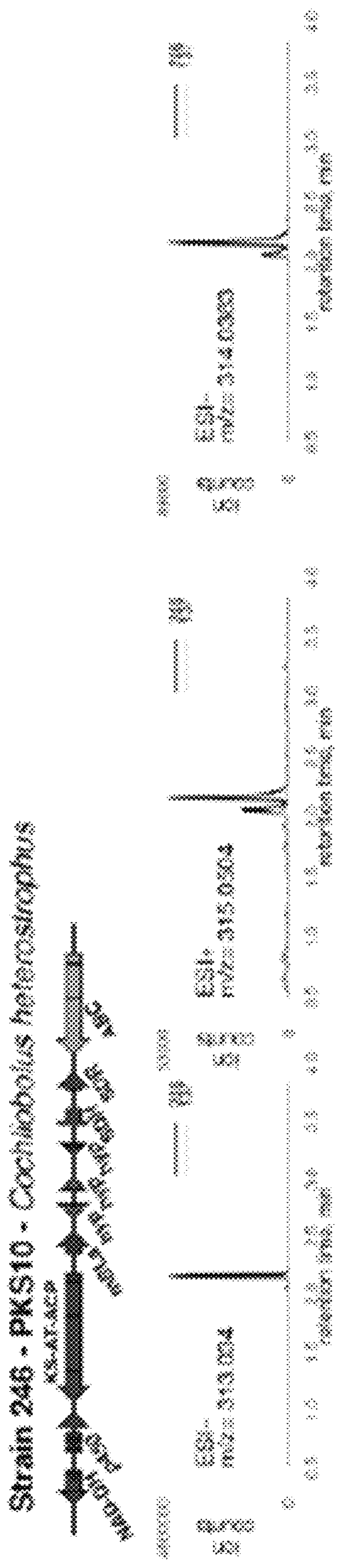
FIG. 37 illustrates features produced by BGC PKS10.
Figure 38:
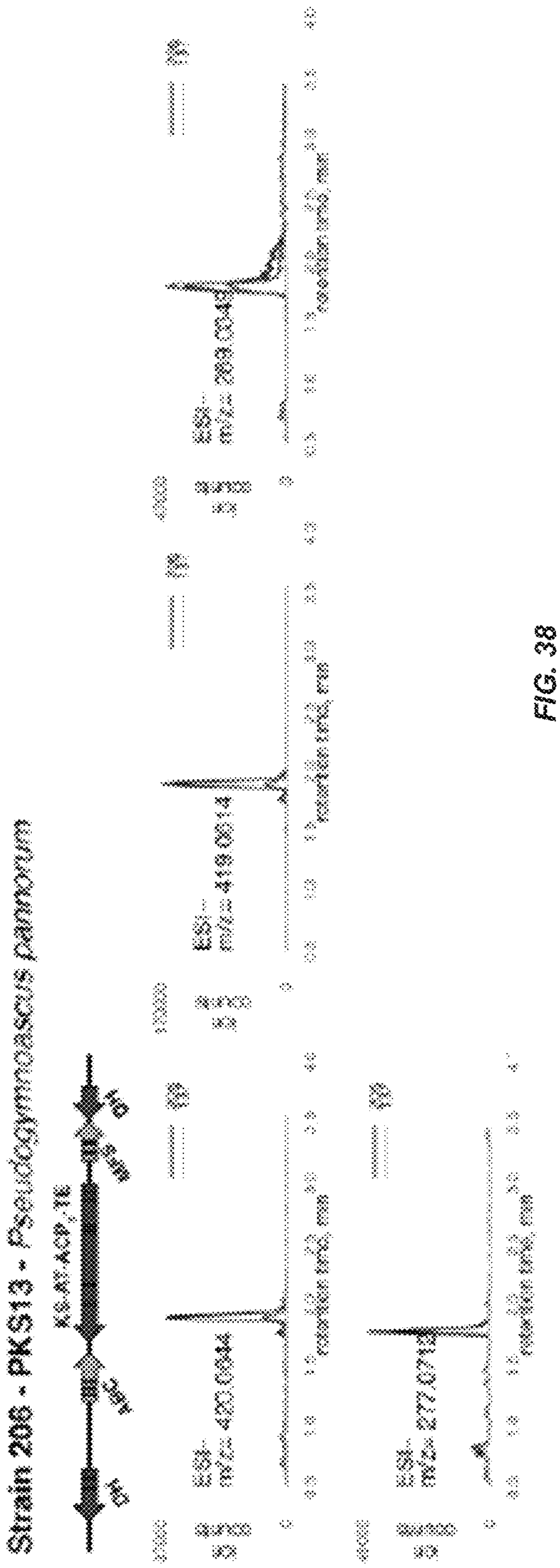
FIG. 38 illustrates features produced by BGC PKS13.
Figure 39:
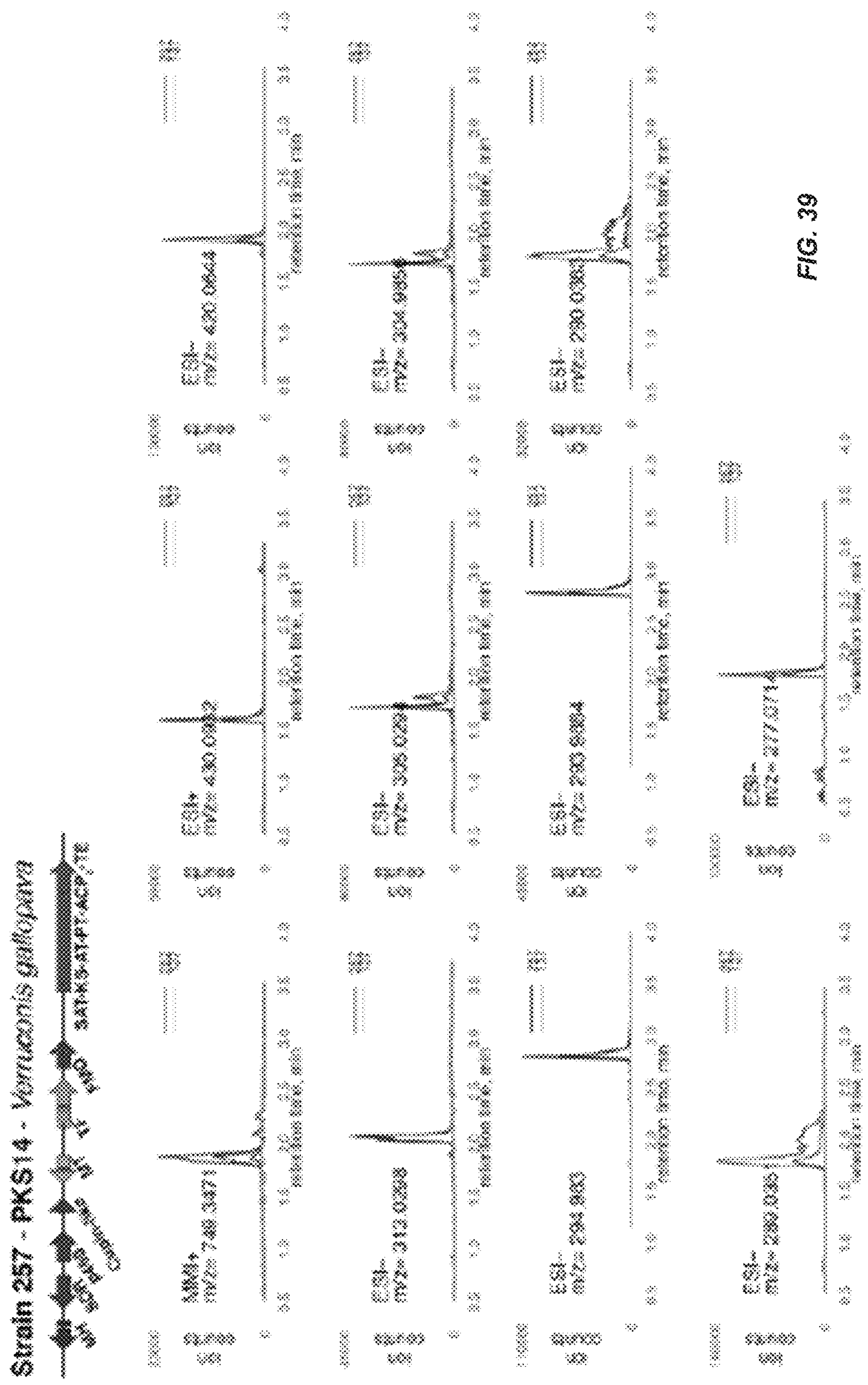
FIG. 39 illustrates features produced by BGC PKS14.
Figure 40:
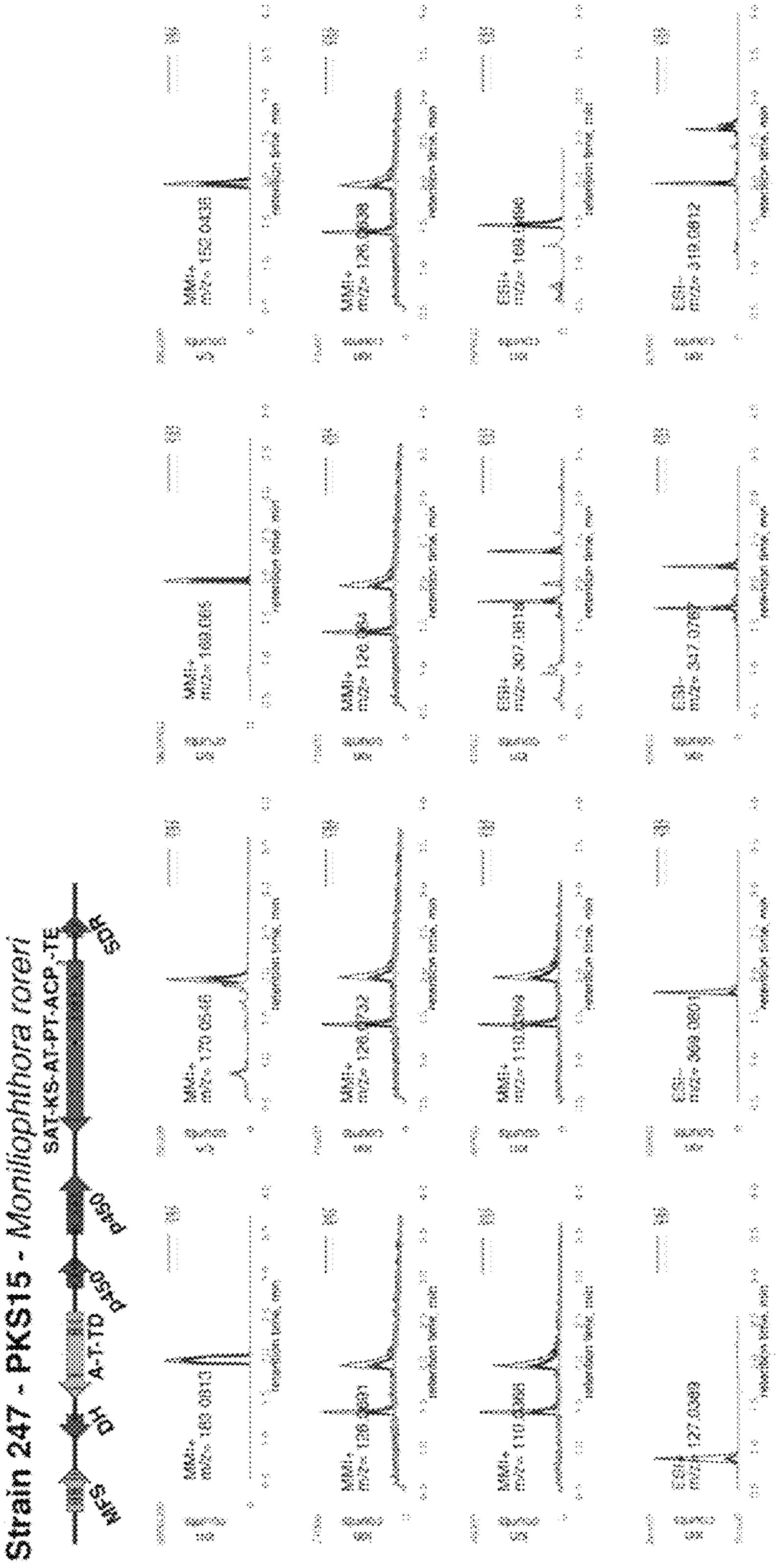
FIG. 40 illustrates features produced by BGC PKS15.
Figure 40:
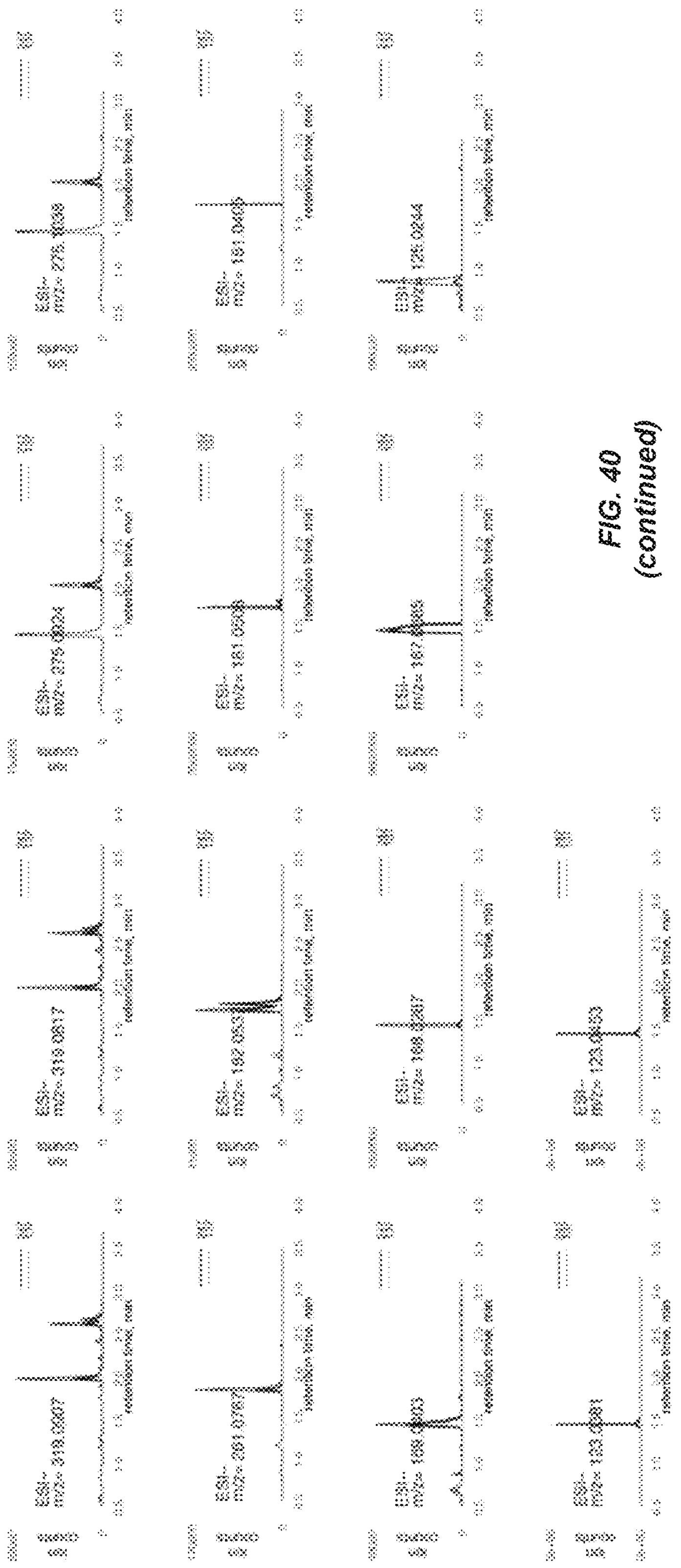
Figure 41:
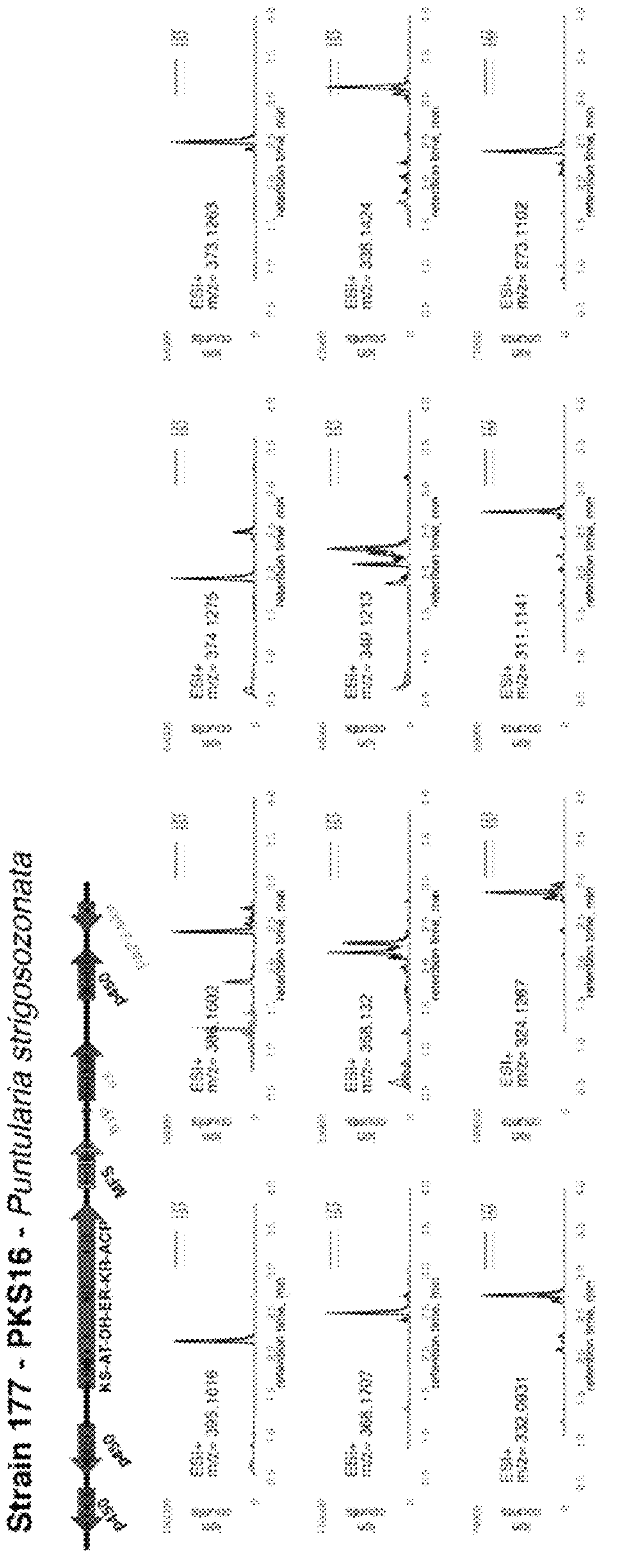
FIG. 41 illustrates features produced by BGC PKS16.
Figure 41:
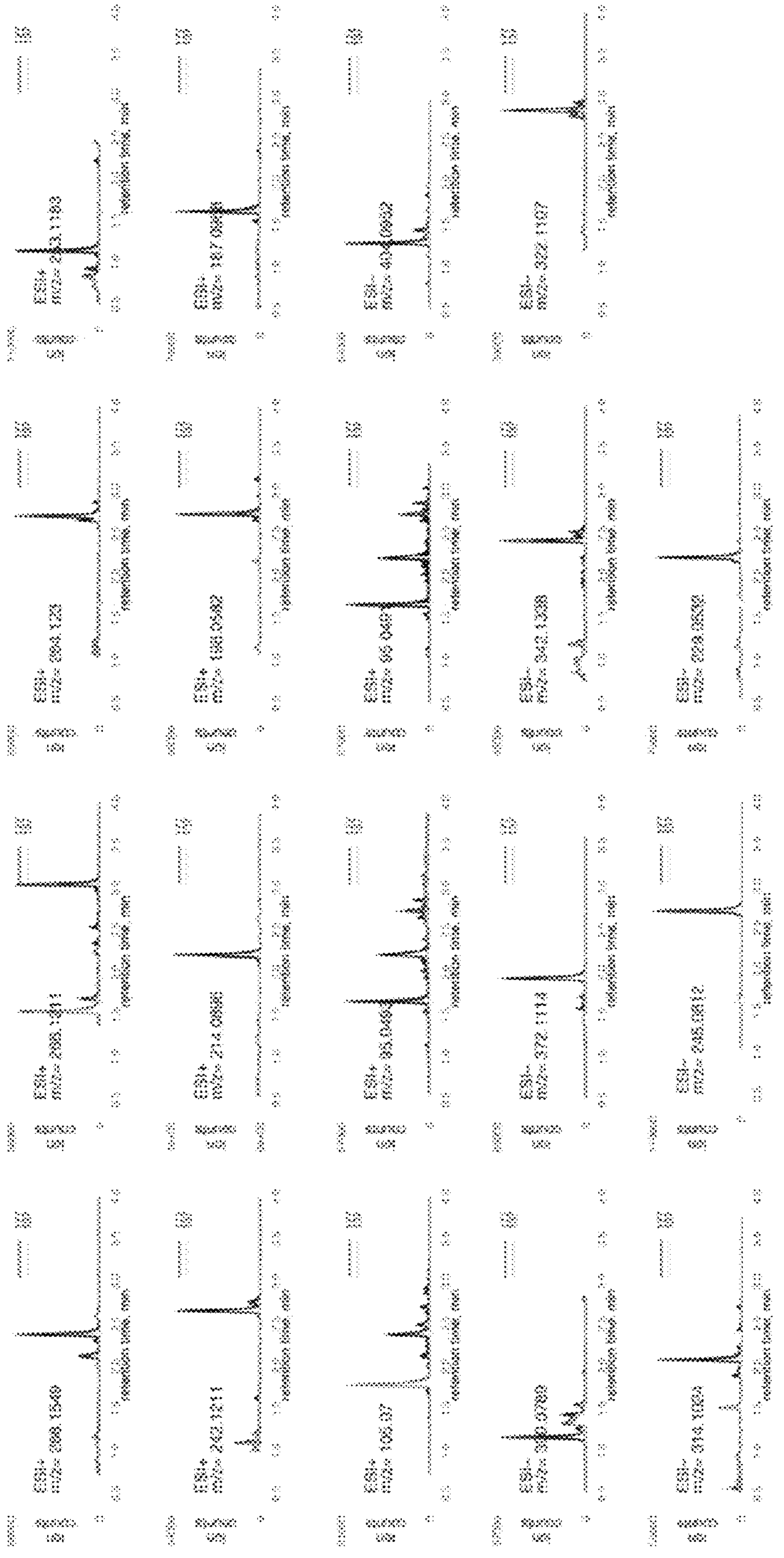
Figure 42:
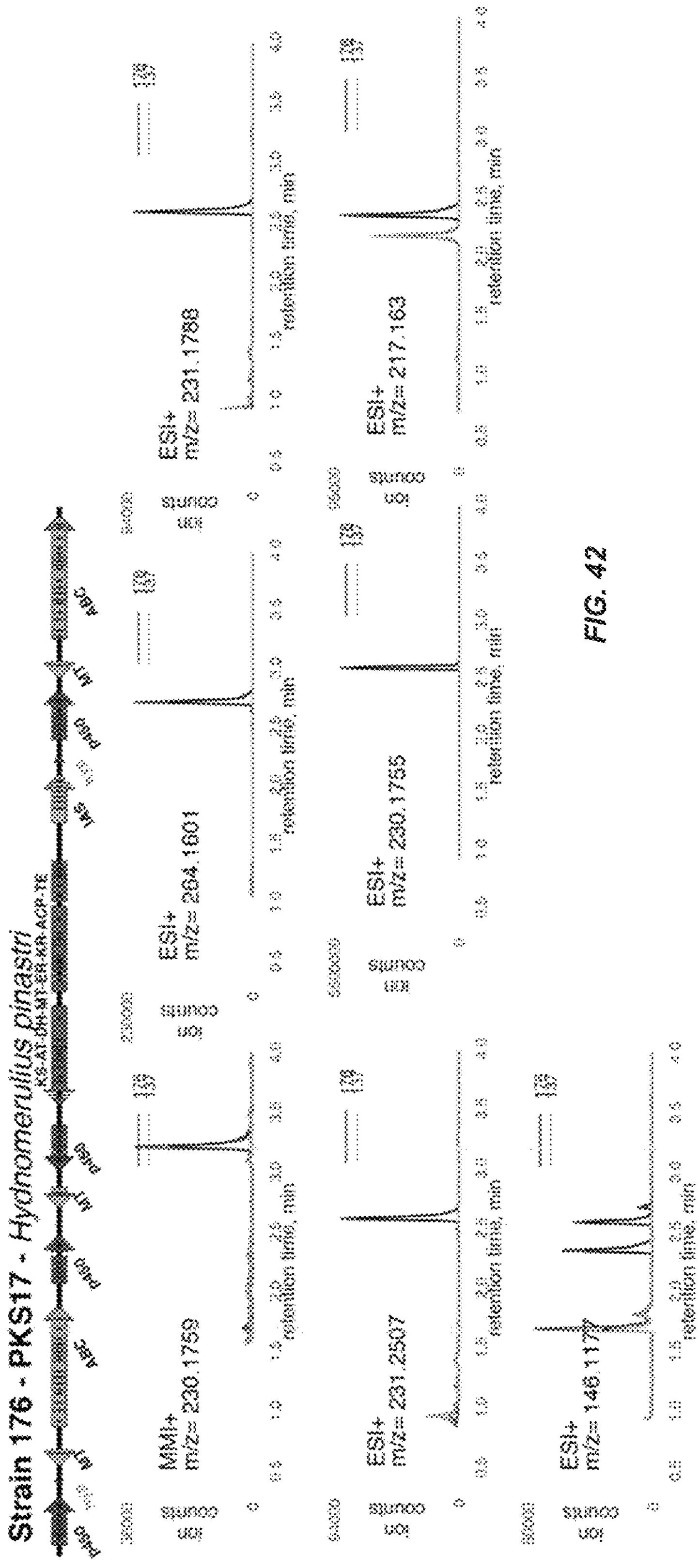
FIG. 42 illustrates features produced by BGC PKS17.
Figure 43:
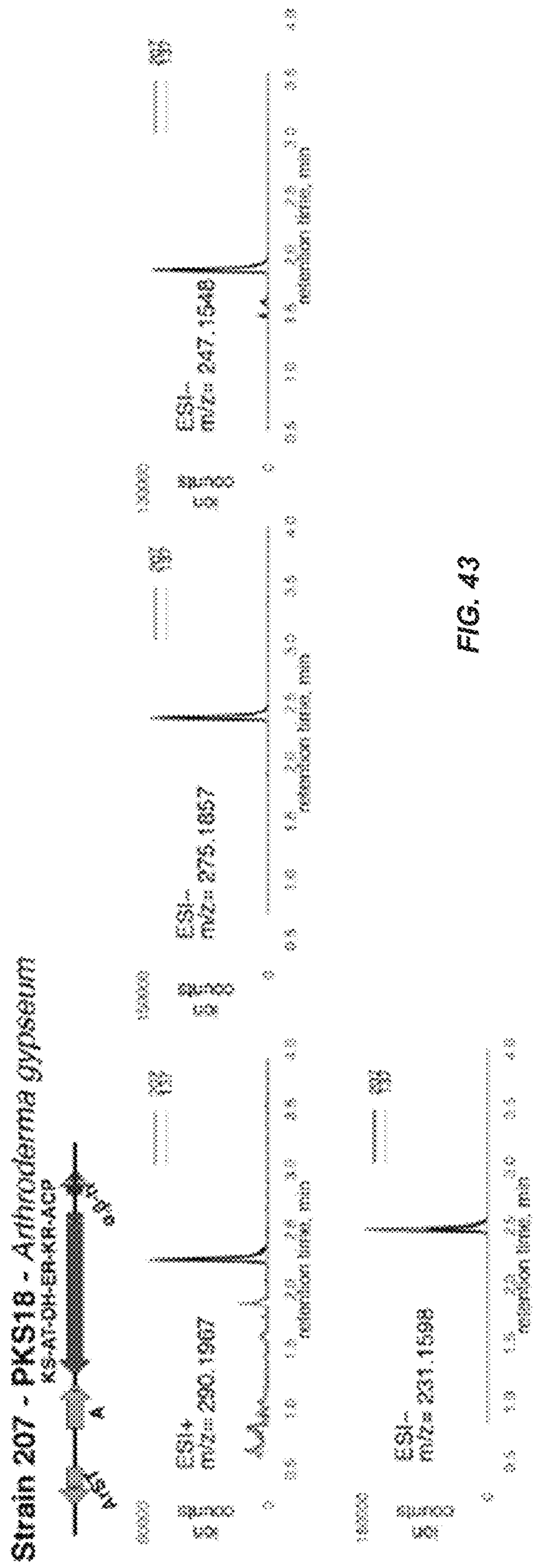
FIG. 43 illustrates features produced by BGC PKS18.
Figure 44:
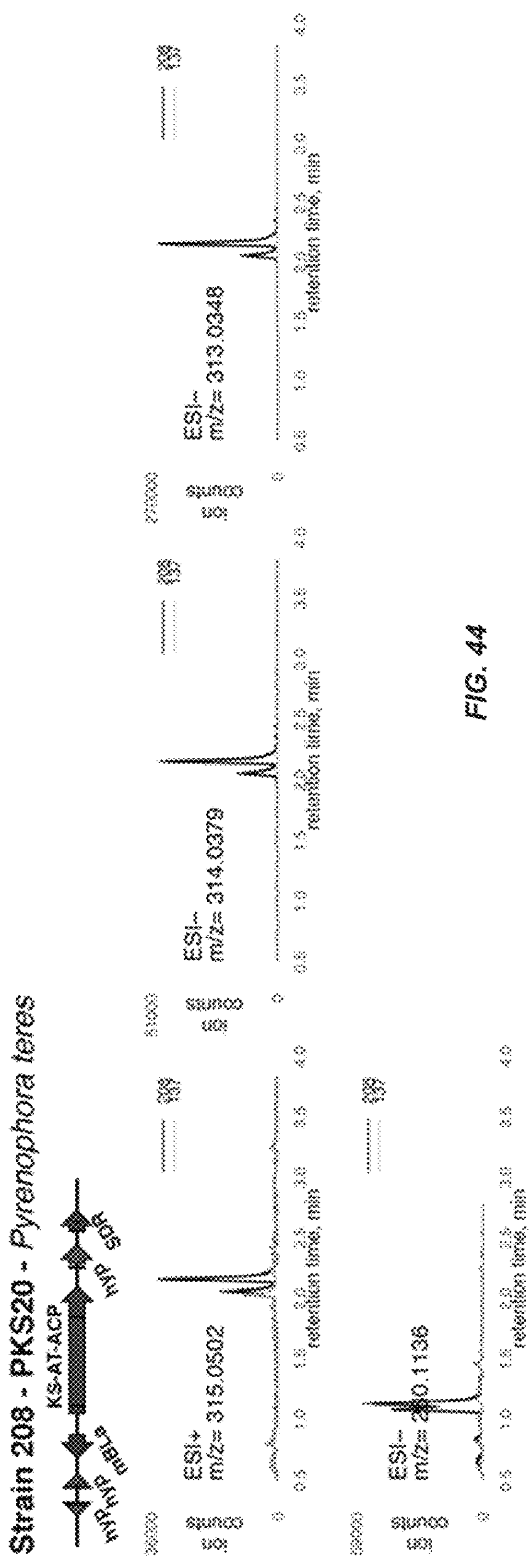
FIG. 44 illustrates features produced by BGC PKS20.
Figure 45:
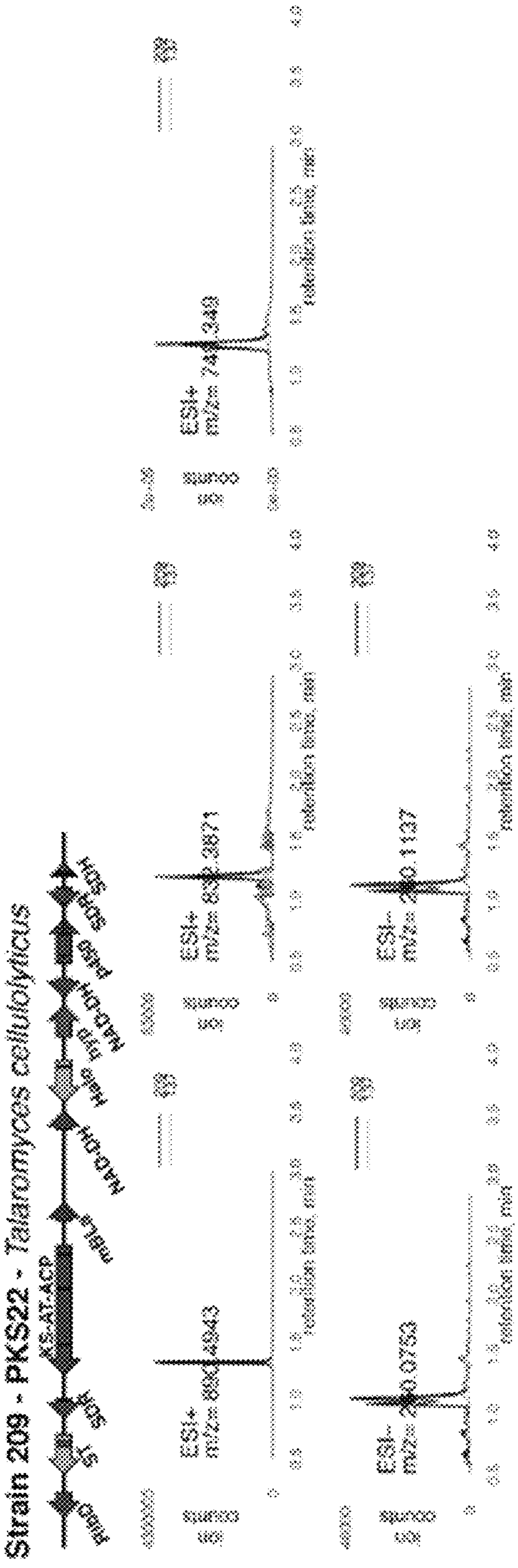
FIG. 45 illustrates features produced by BGC PKS22.
Figure 46:
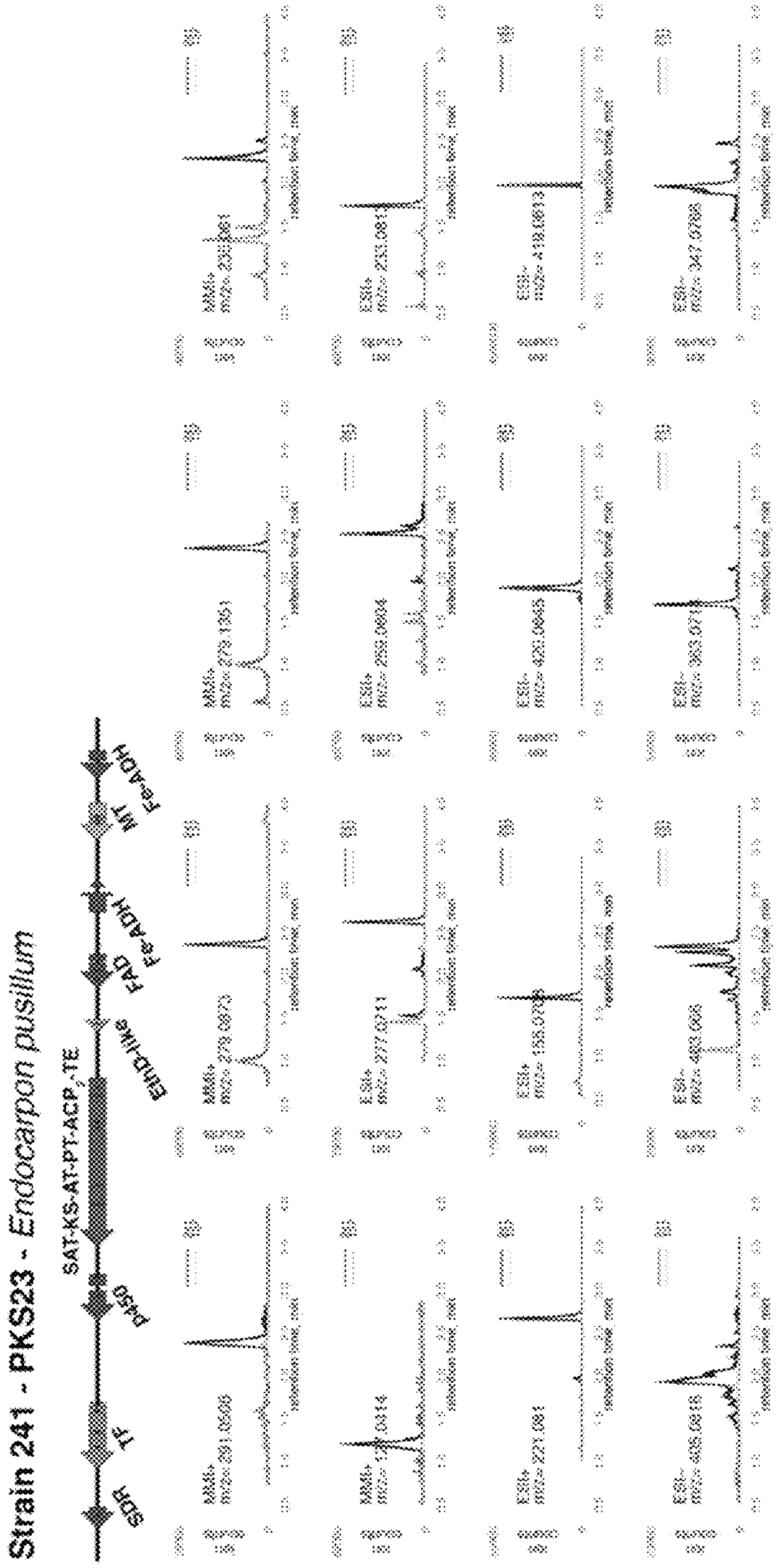
FIG. 46 illustrates features produced by BGC PKS23.
Figure 46:
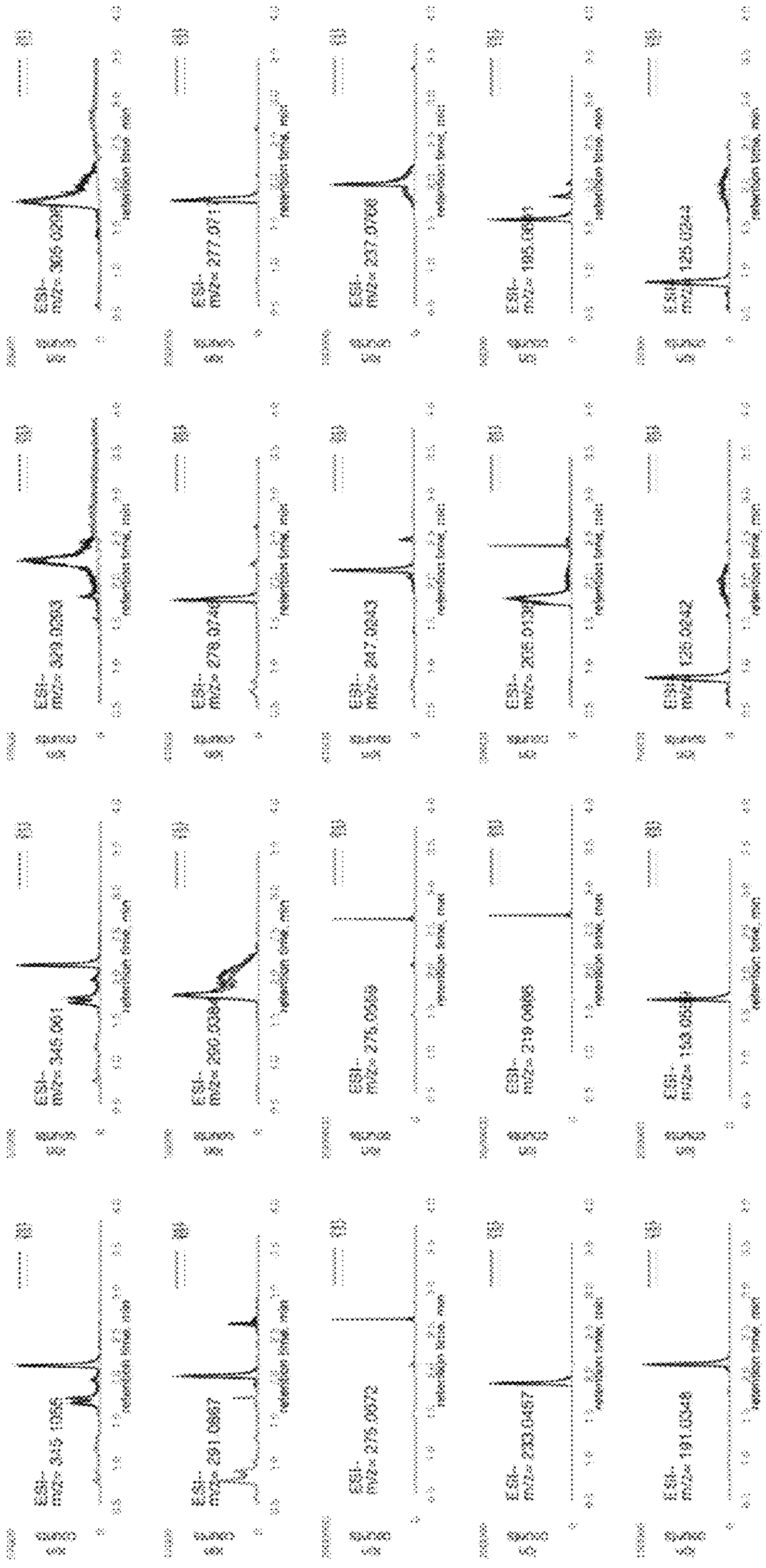
Figure 47:
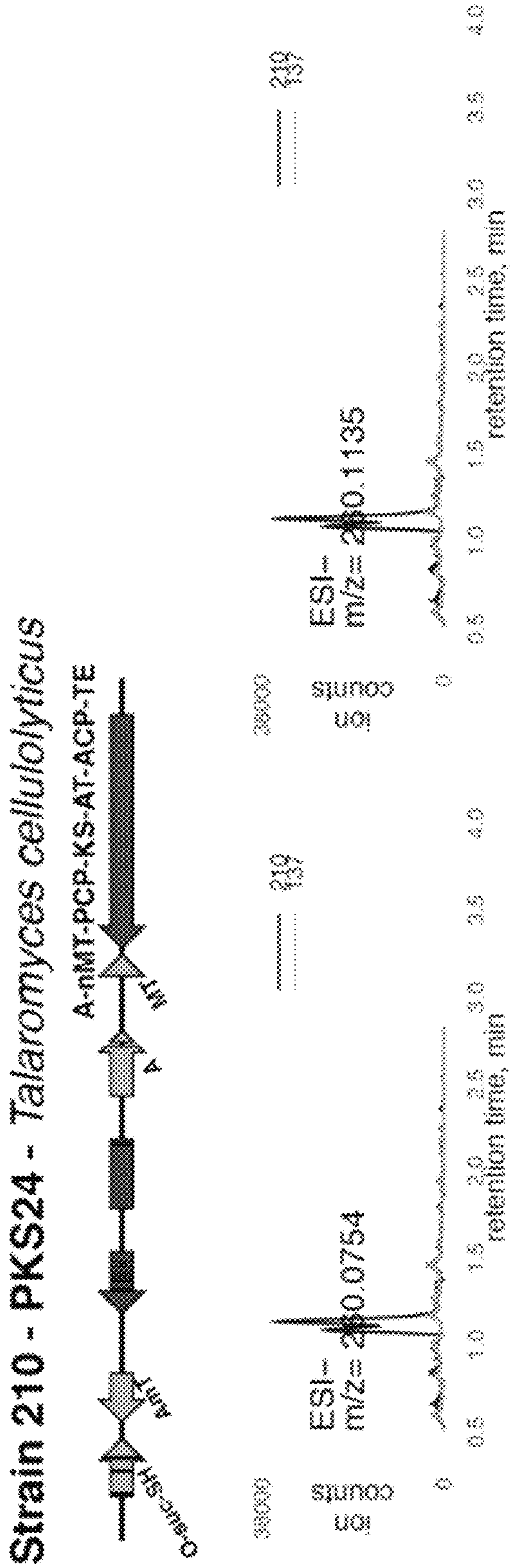
FIG. 47 illustrates features produced by BGC PKS24.
Figure 48:
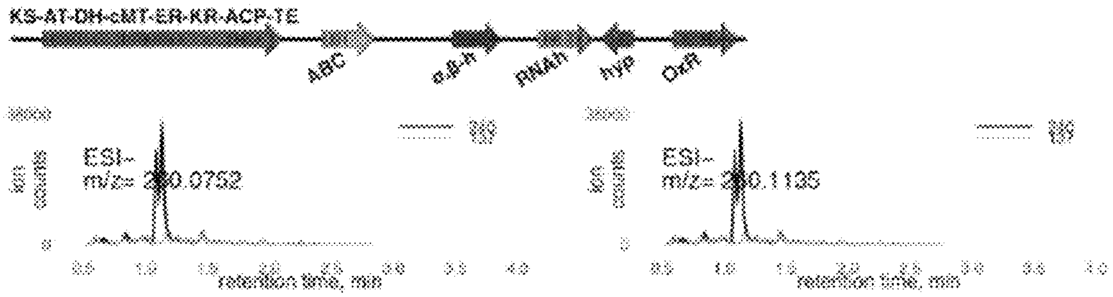
FIG. 48 illustrates features produced by BGC PKS28.
Figure 49:
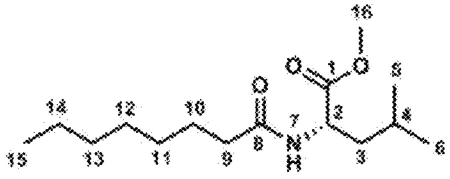
FIG. 49 illustrates NMR data and structure of Compound 6.
Figure 49:
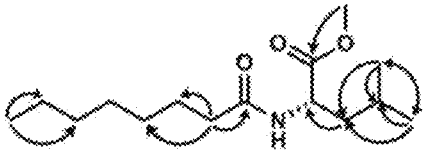
Figure 50:
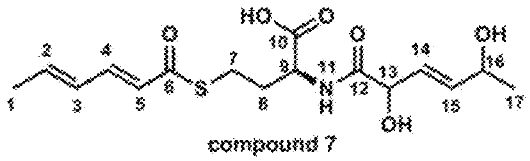
FIG. 50 illustrates NMR data and structure of Compound 7.
Figure 50:
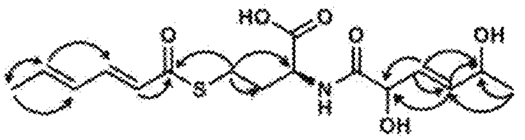
Figure 51:
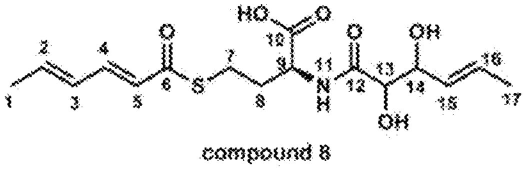
FIG. 51 illustrates NMR data and structure of Compound 8.
Figure 51:
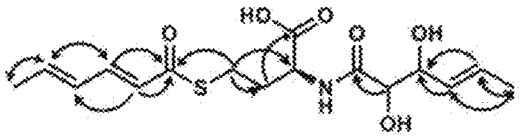
Figure 52:
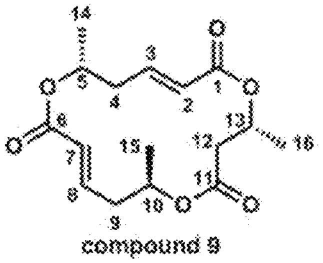
FIG. 52 illustrates NMR data and structure of Compound 9.
Figure 52:
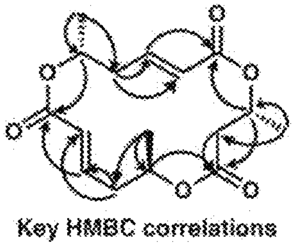
Figure 53:
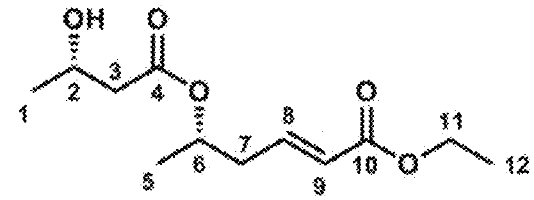
FIG. 53 illustrates NMR data and structure of Compound 10.
Figure 53:
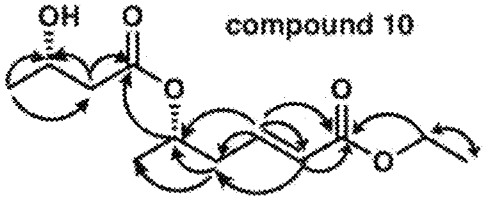
Figure 54:
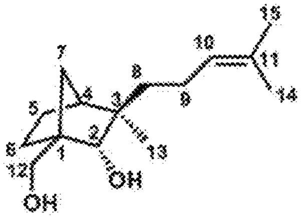
FIG. 54 illustrates NMR data and structure of Compound 11.
Figure 55:
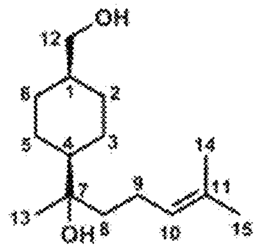
FIG. 55 illustrates NMR data and structure of Compound 12.
Figure 55:
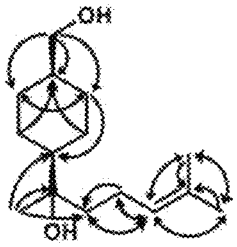
Figure 56:
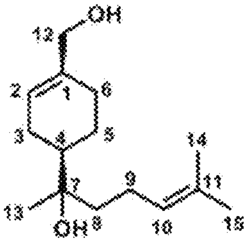
FIG. 56 illustrates NMR data and structure of Compound 13.
Figure 56:
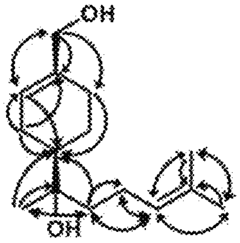
Figure 57:
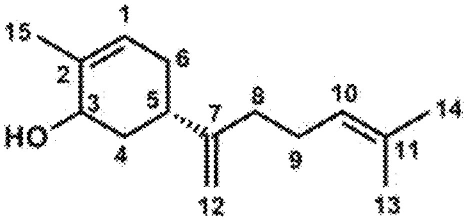
FIG. 57 illustrates NMR data and structure of Compound 14.
Figure 57:
Figure 58:
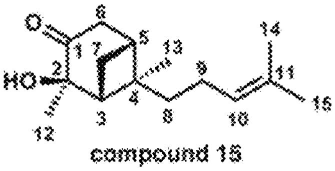
FIG. 58 illustrates NMR data and structure of Compound 15.
Figure 58:
Figure 59:
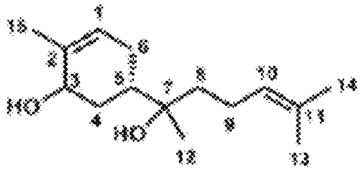
FIG. 59 illustrates NMR data and structure of Compound 16.
Figure 59:
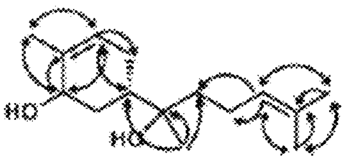

Data analysis by untargeted metabolomics was performed with xcms, using optimal parameters determined by IPO25. For PKS containing clusters, automated analyses were set to generate extracted ion chromatograms (EICs) for the top 50 spectral features as defined by both fold-change and p-value. These EICs were then manually inspected to identify the subset of automatically identified features that appear specific to the expressed BGC as defined by presence in each of three biological replicates of the production strain and absence from three biological replicates of a negative control strain (FIG. 31). EICs of all BGC specific features are illustrated in FIGS. 32-49.

Example 4: Construction of Yeast Strains

In the current example, yeast strains are based on the BY4741/BY4742 background, which is in turn based on S288c (C. B. Brachmann, et al., 1998, cited supra). The strains were made in two stages: 1) creation of a core DHY set with restored sporulation and mitochondrial genome stability and 2) creation of JHY derivatives modified for other benefits, which may include protein production. All changes introduced in this study were confirmed by diagnostic PCR and sequencing.

A sporulation-restored strain set was built by crossing BY4710 (C. B. Brachmann, et al., 1998, cited supra) to a haploid derivative of YAD373 (A. M. Deutschbauer and R. W. Davis, *Nat. Genet.* 37:133-40, 2005), a BY-based diploid that contains three QTLs that restore sporulation: MKT1 (30G), RME1(INS-308A), and TAO3(1493Q). A spore clone from the resulting diploid was repaired for HAP1, which encodes a zinc-finger transcription factor localized to mitochondria and the nucleus. HAP1 is important for mitochondrial genome stability (see J. R. Matoon, E. Caravajal, and D. Gurthrie *Curr. Genet.* 17:179-83, 1990) and likely also important for sporulation. S288c and derivatives contain a Ty1 insertion in the 3' end of HAP1 that inactivates function. The transposon was excised using the Delitto Perfetto method (F. Storici and M. A. Resnick, *Methods Enzymol.* 409:329-45, 2006) and confirmed repaired HAP1 function based on transcription of a CYC1 p-lacZ reporter (M. Gaisne, et al., *Curr. Genet.* 36:195-200, 1999). The sporulation-restored, HAP1-repaired strain and its auxotrophic and prototrophic derivatives were then used to create the DHY set of strains that were additionally restored for mitochondrial genome stability.

The above sporulation-restored strains were used to repair the poor mitochondrial genome stability known to be a problem with S288c and BY derivatives. Mitochondrial genome stability is likely to improve growth and ADH2p-like gene expression under conditions of respiration, and for reducing the frequency of petite cells (slow-growing, respiration-defective cells that cannot grow on non-fermentable carbon sources). For a detailed description of the "mito-repair" method, see construction of JHY650 (J. D. Smith, 2017, cited supra). Briefly, the 50:50 genome editing method was used to introduce the wild-type alleles of three genes shown to be important for mitochondrial genome stability by QTL analysis[31]. The repaired QTLs are: SAL1$^+$ (repair of a frameshift), CAT5(91M) and MIP1(661T). Crosses with prototrophic and auxotrophic strains completed the DHY core set of about a dozen sporulation and mitochondrial genome stability restored strains that can be further modified as needed. DHY213 (see Table 3) is one such strain: it contains the seven desired changes described above, is otherwise congenic with BY4741, and was used in this study to create derivatives for the HEx platform (see Table 3).

Marker-free, seamless deletion of the complete PRB1 and PEP4 ORFs was performed using the 50:50 method (J. Horecka and R. W. Davis, 2014, cited supra). Integration of a 1609 bp ADH2p-npgA-ACS1t expression cassette on the chromosome was performed using a similar method used to integrate DNA segments with the REDI method (J. D. Smith, et al., 2017, cited supra), except that URA3, not FCY1, was used as the counter-selectable marker. For an integration site, an 1166 bp cluster of three transposon LTRs located centromere-distal to YBR209W on chromosome II was replaced (deletion of chrII 643438 to 644603). Two DNA segments were simultaneously inserted via homologous recombination at the integration site that had been cut with SceI to create double strand breaks. One inserted segment was ADH2p-npgA (1448 bp) PCR amplified from a BJ5464/npgA expression strain (npgA from *A. nidulans*) (K. K. M. Lee, N. A. Da Silva, and J. T. Kealey, *Anal. Biochem.,* 394:75-80, 2009). The npgA 3' end was repaired to wildtype using a reverse PCR primer that replaced the npgA intron included previously with the wildtype npgA 3' sequence. To preclude recombination of the expression cassette with the native ADH2 locus, the 161 bp ACS1 terminator was used as the second DNA segment (not ADH2t) and PCR amplified from BY4741. The resulting strain (JHY692) was used in a similar fashion to replace only npgA with the CPR ORF (cytochrome P450 reductase, ATEG_05064 from *A. terreus*). Finally, a strain with both npgA and CPR expression cassettes (JHY702) was created by mating JHY692 and JHY705.

Example 5: Determination of Chemical Structures

For compound isolation, large-scale fermentation was carried out with the strains and clusters of Example 3. The yeast strains were first struck out onto the appropriate SDC dropout agar plates and incubated for 48 hrs at 30° C. A colony was then inoculated into 40 mL SDC dropout medium and incubated at 28° C. for two days with shaking at 250 rpm. This seed culture was used to inoculate 4 L of YPD medium (1.5% Glucose) and cultured for 3 days at 28° C. and 250 rpm. Supernatants were then clarified by centrifugation and extracted with equal volume of ethyl acetate. Cell pellets were extracted with 1 L of acetone. For compounds containing carboxylic acid groups, the pH value of the supernatant was adjusted to 3 by adding HCl prior to extraction. The organic phases were combined and evaporated to dryness. The residue was purified by ISCO-CombiFlash® Rf 200 (Teledyne Isco, Inc) with a gradient of hexane and acetone. After analysis by LC-MS, the fractions containing the target compounds were combined and further purified by semi-preparative HPLC using C18 reverse-phase column. The purity of each compound was confirmed by LC-MS, and the structure was solved by NMR (FIG. 49-59).

All NMR spectra including $^{1}H$, $^{13}C$, COSY, HSQC, HMBC and NOESY spectra were obtained on Bruker AV500 spectrometer with a 5 mm dual cryoprobe at the UCLA Molecular Instrumentation Center. The NMR solvents used for these experiments were purchased from Cambridge Isotope Laboratories, Inc.

TABLE 4

Summary of control and cryptic fungal BGCs examined in this study.

| Cluster ID | Type | Native Locus: Genbank ID | Native Locus: Start | Native Locus: End | Native Locus: Length | Species of origin | Division | Productive? |
|---|---|---|---|---|---|---|---|---|
| IDT | Ctl | | | | | *Aspergillus tubingensis* | Ascomycota | Y |
| DHZ | Ctl | | | | | *Hypomyces subiculosus* | Ascomycota | Y |
| PKS1 | PKS | KV441552 | 530394 | 546723 | 16329 | *Coniothyrium sporulosum* | Ascomycota | Y |

TABLE 4-continued

Summary of control and cryptic fungal BGCs examined in this study.

| Cluster ID | Type | Genbank ID | Native Locus Start | End | Length | Species of origin | Division | Productive? |
|---|---|---|---|---|---|---|---|---|
| PKS2 | PKS | KV441551 | 60641 | 83767 | 23126 | *Coniothyrium sporulosum* | Ascomycota | Y |
| PKS3 | PKS | Deposition pending | | | 9892 | *Acremonium* Sp. KY4917 | Ascomycota | N |
| PKS4 | PKS | AM270992 | 578654 | 603367 | 24713 | *Aspergillus niger* | Ascomycota | Y |
| PKS5 | PKS | CP003009 | 8730831 | 8753560 | 22729 | *Thielavia terrestris* | Ascomycota | N |
| PKS6 | PKS | ABDF02000052 | 9685 | 28459 | 18774 | *Trichoderma virens* | Ascomycota | Y |
| PKS7 | PKS | JPJY01000093 | 2671 | 30026 | 27355 | *Pseudo-gymnoascus pannorum* | Ascomycota | N |
| PKS8 | PKS | JOWA01000110 | 1607857 | 1643205 | 35348 | *Scedosporium apiospermum* | Ascomycota | Y |
| PKS9 | PKS | KE384750 | 270098 | 292755 | 22657 | *Metarhizium anisopliae* | Ascomycota | N |
| PKS10 | PKS | KB445572 | 91380 | 115199 | 23819 | *Cochliobolus heterostrophus* | Ascomycota | Y |
| PKS11 | PKS | JPKB01001000 | 12749 | 37136 | 24387 | *Pseudo-gymnoascus pannorum* | Ascomycota | N |
| PKS12 | PKS | JPJU01000852 | 23274 | 38823 | 15549 | *Pseudo-gymnoascus pannorum* | Ascomycota | N |
| PKS13 | PKS | JPJR01000396 | 848 | 19416 | 18568 | *Pseudo-gymnoascus pannorum* | Ascomycota | Y |
| PKS14 | PKS | KN847553 | 300827 | 326489 | 25662 | *Verruconis gallopava* | Ascomycota | Y |
| PKS15 | PKS | AWSO01000045 | 179446 | 203577 | 24131 | *Monilio-phthora roreri* | Basidiomycota | Y |
| PKS16 | PKS | JH687542 | 431482 | 465332 | 33850 | *Punctularia strigosozonata* | Basidiomycota | Y |
| PKS17 | PKS | KN839868 | 143119 | 188013 | 44894 | *Hydno-merulius pinastri* | Basidiomycota | Y |
| PKS18 | PKS | DS989828 | 1389449 | 1407499 | 18050 | *Arthroderma gypseum* | Ascomycota | Y |
| PKS19 | PKS | KB908593 | 409171 | 443069 | 33898 | *Setosphaeria turcica* | Ascomycota | N |
| PKS20 | PKS | GL532685 | 4724 | 17845 | 13121 | *Pyrenophora-teres* | Ascomycota | Y |
| PKS21 | PKS | AMGW01000002 | 1294251 | 1322017 | 27766 | *Cladophia-lophora yegresit* | Ascomycota | N |
| PKS22 | PKS | DF933843 | 225991 | 254307 | 28316 | *Talaromyces cellulolyticus* | Ascomycota | Y |
| PKS23 | PKS | KE720645 | 48853 | 80314 | 31461 | *Endocarpon pusillum* | Ascomycota | Y |
| PKS24 | PKS | DF933834 | 523551 | 558018 | 34467 | *Talaromyces cellulolyticus* | Ascomycota | Y |
| PKS25 | PKS | AWSO01000633 | 5071 | 30440 | 25369 | *Monilio-phthoraroreri* | Basidiomycota | N |
| PKS26 | PKS | KN817529 | 130968 | 152240 | 21272 | *Hypholoma sublateritium* | Basidiomycota | N |
| PKS27 | PKS | KB445800 | 1362248 | 1403385 | 41137 | *Ceriporiopsis subvermispora* | Basidiomycota | N |
| PKS28 | PKS | AWSO01000632 | 8804 | 37857 | 29053 | *Monilio - phthoraroreri* | Basidiomycota | Y |
| TC1 | UTC | ABDF02000086 | 384012 | 368868 | 15144 | *Trichoderma Virens* | Ascomycota | Y |
| TC2 | UTC | ABDF02000083 | 37740 | 49247 | 11507 | *Trichoderma Virens* | Ascomycota | N |
| TC3 | UTC | FQ790293 | 97750 | 131296 | 33546 | *Botryotonia cinerea* | Ascomycota | Y |
| TC4 | UTC | JH717969 | 858521 | 869226 | 10705 | *Formitiporia mediterranea* | Basidiomycota | Y |
| TC5 | UTC | KI925459 | 2412992 | 2432365 | 19373 | *Heterobasidion annosum* | Basidiomycota | Y |
| TC6 | UTC | KB445798 | 581049 | 618823 | 37774 | *Ge/atoporia subvermispora* | Basidiomycota | N |

TABLE 4-continued

Summary of control and cryptic fungal BGCs examined in this study.

| Cluster ID | Type | Native Locus Genbank ID | Start | End | Length | Species of origin | Division | Productive? |
|---|---|---|---|---|---|---|---|---|
| TC7 | UTC | JH719450 | 83620 | 114270 | 30650 | *Dichomitus squalens* | Basidiomycota | N |
| TC8 | UTC | KL198014 | 1718438 | 1746540 | 28102 | *Pleurotus ostreatus* | Basidiomycota | N |
| TC9 | UTC | GL377319 | 205808 | 212935 | 7127 | *Schizophyllum commune* | Basidiomycota | Y |
| TC10 | UTC | JH687394 | 99692 | 114281 | 14589 | *Stereum hirsutum* | Basidiomycota | N |
| TC11 | UTC | JH687396 | 33983 | 48346 | 14363 | *Sternum hirsutum* | Basidiomycota | N |
| TC12 | UTC | JH719415 | 280135 | 300470 | 20335 | *Dichomitus squalens* | Basidiomycota | N |
| TC13 | UTC | JH795868 | 73132 | 97338 | 24206 | *Dacryopinax primogenitus* | Basidiomycota | N |
| | | | | | | | Total | 43 |
| | | | | | | | Productive | 24 |

TABLE 5

Ion source parameters used in this study

| Ion source parameter | Dual AJS | MMI |
|---|---|---|
| gas temperature | 250° C. | 350° C. |
| drying gas | 12 L/min | 7.5 L/min |
| nebulizer | 10 psig | 20 psig |
| sheath gas temp. | 400° C. | — |
| sheath gas flow | 12 L/min | — |
| vaporizer | — | 250° C. |
| capillary voltage (Vcap) | 3500 V | 1500 V |
| nozzle voltage | 1400 V | — |
| corona discharge | — | 4 μA |
| fragmentor | 100 V | 120 V |
| skimmer | 50 V | 50 V |
| octopole 1 RF Vpp | 750 V | 750 V |
| charging voltage | — | 1000 V |

TABLE 6

Description of promoter sequences

| SEQ ID NO. | Description |
|---|---|
| 1 | *S. cerevisiae* pADH2 |
| 2 | *S. cerevisiae* pPCK1 |
| 3 | *S. cerevisiae* pMLS1 |
| 4 | *S. cerevisiae* pICL1 |
| 5 | *S. cerevisiae* pYLR307C-A |
| 6 | *S. cerevisiae* pYGR067C |
| 7 | *S. cerevisiae* pIDP2 |
| 8 | *S. cerevisiae* pADY2 |
| 9 | *S. cerevisiae* pGAC1 |
| 10 | *S. cerevisiae* pECM13 |
| 11 | *S. cerevisiae* pFAT3 |
| 12 | *S. cerevisiae* pPUT1 |
| 13 | *S. cerevisiae* pNQM1 |
| 14 | *S. cerevisiae* pSFC1 |
| 15 | *S. cerevisiae* pJEN1 |
| 16 | *S. cerevisiae* pSIP18 |
| 17 | *S. cerevisiae* pAT02 |
| 18 | *S. cerevisiae* pYIG1 |
| 19 | *S. cerevisiae* pFBP1 |
| 20 | *S. cerevisiae* PHO89 |
| 21 | *S. cerevisiae* CAT2 |

TABLE 6-continued

Description of promoter sequences

| SEQ ID NO. | Description |
|---|---|
| 22 | *S. cerevisiae* CTA1 |
| 23 | *S. cerevisiae* ICL2 |
| 24 | *S. cerevisiae* ACS1 |
| 25 | *S. cerevisiae* PDH1 |
| 26 | *S. cerevisiae* REG2 |
| 27 | *S. cerevisiae* CIT3 |
| 28 | *S. cerevisiae* CFRC1 |
| 29 | *S. cerevisiae* RGI2 |
| 30 | *S. cerevisiae* PUT4 |
| 31 | *S. cerevisiae* NCA3 |
| 32 | *S. cerevisiae* STL1 |
| 33 | *S. cerevisiae* ALP1 |
| 34 | *S. cerevisiae* NDE2 |
| 35 | *S. cerevisiae* QNQ1 |
| 36 | *S. paradoxus* pADH2 |
| 37 | *S. kudriavzevii* pADH2 |
| 38 | *S. bayanus* pADH2 |
| 39 | *S. mikitae* pADH2 |
| 40 | *S. castellii* pADH2 |
| 41 | *S. paradoxus* pPCK1 |
| 42 | *S. kudriavzevii* pPCK1 |
| 43 | *S. bayanus* pPCK1 |
| 44 | *S. paradoxus* pMLS1 |
| 45 | *S. kudriavzevii* pMLS1 |
| 46 | *S. bayanus* pMLS1 |
| 47 | *S. paradoxus* pICL1 |
| 48 | *S. kudriavzevii* pICL1 |
| 49 | *S. bayanus* pICL1 |
| 50 | *S. cerevisiae* pTDH3 |
| 51 | *S. cerevisiae* pTEF1 |
| 52 | *S. cerevisiae* pFBA1 |
| 53 | *S. cerevisiae* pPDC1 |
| 54 | *S. cerevisiae* pTPI1 |
| 55 | *S. cerevisiae* tADH2 |
| 56 | *S. cerevisiae* tPGI1 |
| 57 | *S. cerevisiae* tENO2 |
| 58 | *S. cerevisiae* tTEF1 |
| 59 | *A. tubingensis* GGPPS |
| 60 | *A. tubingensis* PT |
| 61 | *A. tubingensis* FMO |
| 62 | *A. tubingensis* Cyc |

TABLE 6-continued

| Description of promoter sequences | |
|---|---|
| SEQ ID NO. | Description |
| 63 | *H. subiculosis* hpm8 |
| 64 | *H. subiculosis* hpm3 |
| 65 | pCHIDT-2.1 |
| 66 | pCHIDT-2c |

TABLE 7

| Description of gene sequences | | |
|---|---|---|
| Cluster ID NO. | SEQ ID NO. | Description |
| AFU3G | 67 | AFOC1 |
| | 68 | AFOC9 |
| | 69 | AFOC6 |
| | 70 | AFOC5 |
| | 71 | AFOC8 |
| | 72 | AFOC4 |
| | 73 | AFOC7 |
| | 74 | AFOC5N |
| | 75 | AFOC2_PKS |
| | 76 | AFOC3 |
| Afu1g17740 | 77 | A1OC1_TF |
| | 78 | A1OC2_serine_hydrolase |
| | 79 | A1OC3_aldose_epimerase |
| | 80 | A1OC4_P450 |
| | 81 | Afu1g17740_2_PKS |
| Ca157 | 82 | Ca157_1_SDR |
| | 83 | Ca157_2_Acyl_CoA_oxidase |
| | 84 | Ca157_3_P450 |
| | 85 | Ca157_4_FMO |
| | 86 | Ca157_5_PKS |
| | 87 | Ca157_6_transferase |
| | 88 | Ca157_7_PfpI |
| | 89 | Ca157_8_hyp |
| | 90 | Ca157_9_AB_hydrolase |
| | 91 | Ca157_10_hyp |
| Ca2032 | 92 | Ca2032_1_3_GHMP_kinase |
| | 93 | Ca2032_1_PKS |
| | 94 | Ca2032_3_MT |
| | 95 | Ca2032_4_P450 |
| | 96 | Ca2032_5_Ca_uniporter |
| | 97 | Ca2032_6_GNAT_acetyltransferase |
| KU14 | 98 | KU14_SC3_4774_Cyclase |
| | 99 | KU14_SC3_4776_P450 |
| | 100 | KU14_SC3_4773_polyprenyl_synthetase |
| | 101 | KU14_SC3_4771_AK_reductase |
| | 102 | KU14_SC3_4770_polyprenyl_synthetase |
| | 103 | KU14_SC3_4768_AK_reductase |
| | 104 | KU14 SC3_4772_DNA_repair |
| | 105 | KU14_SC3_47775_QacA_drug_transporter |
| | 106 | KU14_SC3_4769_Hyp |
| | 107 | KU18_SH9_7287_Cyclase |
| | 108 | KU18_SH9_7288_P450 |
| | 109 | KU18_SH9_7289_P450 |
| | 110 | KU18_SH9_7286_P450 |
| | 111 | KU18_SH9_7285_DH |
| | 112 | KU26_ETS81063.1_metallo_hydrolase |
| | 113 | KU26_ETS81064.1_hyp |
| | 114 | KU26_ETS81065.1_esterase |
| | 115 | KU26_ETS81066.1_PKS |
| | 116 | KU26_ETS81067.1_hyp |
| | 117 | KU26_ETS81068.1 SDR |
| | 118 | KU26_ETS81069.1_SDR |
| | 119 | KU29_BO23_6166_ADH |
| | 120 | KU29_BO23_6167_aminotransferase_3 |
| | 121 | KU29_BO23_6168_fasciclin |
| | 122 | KU29_BO23_6169_hyp |
| | 123 | KU29_BO23_6170_esterase |
| | 124 | KU29_BO23_6171_glycoside_hydrolase |
| | 125 | KU29_BO23_6172_hyp |
| | 126 | KU29_BO23_6173_P450 |
| | 127 | KU29_BO23_6174_PKS |
| | 128 | KU40_KFA56048.1_NmrA_like |

TABLE 7-continued

Description of gene sequences

| Cluster ID NO. | SEQ ID NO. | Description |
|---|---|---|
| | 129 | KU40_KFA56160.1_hyp |
| | 130 | KU40_KFA56046.1_phytanoly-CoA_dioxygenase |
| | 131 | KU40_KFA56190.1_NmrA_like |
| | 132 | KU40_KFA56035.1_PKS |
| | 133 | KU40_KFA56227.1_hyp |
| | 134 | KU40_KFA56040.1_hyp |
| | 135 | KU40_KFA56229.1_alkaline_serine_protease |
| KU41 | 136 | KU41_KIL85236.1_phenylalanine_specific_permease |
| | 137 | KU41_KIL85237.1_aldehyde_DH |
| | 138 | KU41_KIL85238.1_DH |
| | 139 | KU41_KIL85239.1_hyp |
| | 140 | KU41_KIL85240.1_hyp |
| | 141 | KU41_KIL85241.1_hyp |
| | 142 | KU41_KIL85242.1_1-amino_cyclopropane-1-carboxylate_oxidase |
| | 143 | KU41_KIL85243.1_hyp |
| | 144 | KU41_KIL85244.1_PKS |
| | 145 | KU41_KIL85245.1_hyp |
| | 146 | KU41_KIL85246.1_aromatic_dioxygenase |
| | 147 | KU41_KIL85247.1_peptidase |
| | 148 | KU41_KIL85248.1 kinase |
| | 149 | KU41_KIL85249.1_metalloprotease |
| | 150 | KU41_KIL85250.1_BLA |
| | 151 | KU41_KIL85251.1_SDR |
| | 152 | KU41_KIL85252.1_AK_reductase |
| | 153 | KU41_KIL85253.1_metallopeptidase |
| KU44 | 154 | KU44_SL06_4460_TPR_repeat |
| | 155 | KU44_SL06_4461_PKS |
| | 156 | KU44_SL06_4462_aminotransferase_V |
| | 157 | KU44_SL06_4463_MFS_transporter |
| PKS1 | 158 | CS100GC1_CDS1_PKS |
| | 159 | CS100GC1_CDS2_serine_hydrolase |
| | 160 | CS100GC1_CDS3_p450 |
| | 161 | CS100GC1_CDS4_short_chain_dehydrogenase |
| | 162 | CS100GC1_CDS5_FAD_dehydrogenase |
| PKS10 | 163 | KU34_CH10_1770_epimerase_DH |
| | 164 | KU34_CH10_1802_P450 |
| | 165 | KU34_CH10_1821_PKS |
| | 166 | KU34_CH10_1888_metallo_bla |
| | 167 | KU34_CH10_1909_hyp |
| | 168 | KU34_CH10_1922_DUF1772 |
| | 169 | KU34_CH10_1937_NTF2_like |
| | 170 | KU34_CH10_1951_NmrA_like |
| | 171 | KU34_CH10_1975_SDR |
| | 172 | KU34_CH10_2002_ABC_transporter |
| PKS11 | 173 | KU35_KFY73936.1_SDR |
| | 174 | KU35_KFY73937.1_DUF_3425 |
| | 175 | KU35_KFY73938.1_Zn_finger |
| | 176 | KU35_KFY73939.1_OMT |
| | 177 | KU35_KFY73940.1_metallo_lactamase |
| | 178 | KU35_KFY73941.1_PKS |
| | 179 | KU35_KFY73942.1_acetyl_transferase |
| | 180 | KU35_KFY73943.1_NmrA_like |
| | 181 | KU35_KFY73944.1_FAD_linked_oxygenase |
| PKS12 | 182 | KU36_KFY14209.1_hyp |
| | 183 | KU36_KFY14210.1_OMT |
| | 184 | KU36_KFY14211.1_Metallo_BLA |
| | 185 | KU36_KFY14212.1_PKS |
| | 186 | KU36_KFY14213.1_FAD_linked_oxidase |
| PKS13 | 187 | KU37_KFY01907.1_DH |
| | 188 | KU37_KFY01908.1_ABC_tranporter |
| | 189 | KU37_KFY01909.1_PKS |
| | 190 | KU37_KFY01910.1_MFS |
| | 191 | KU37_KFY01911.1_PKc_like |
| PKS14 | 192 | KU38_KIW01747.1_metallo_hydrolase |
| | 193 | KU38_KIW01748.1_halogenase |
| | 194 | KU38_KIW01749.1_P450 |
| | 195 | KU38_KIW01750.1_cupin_like |
| | 196 | KU38_KIW01751.1_OMT |
| | 197 | KU38_KIW01752.1_MHR_TF |
| | 198 | KU38_KIW01753.1_monoxygenase |
| | 199 | KU38_KIW01754.1_PKS |
| PKS15 | 200 | KU39_ESK96608.1_monocarboxylate_permease |
| | 201 | KU39_ESK96609.1_NAD_epimerase_DH |
| | 202 | KU39_ESK96610.1_hyp |
| | 203 | KU39_ESK96611.1_carbonyl_reductase |

TABLE 7-continued

Description of gene sequences

| Cluster ID NO. | SEQ ID NO. | Description |
|---|---|---|
| | 204 | KU39_ESK96612.1_phenol_2_monoxygenase |
| | 205 | KU39_ESK96613.1_PKS |
| | 206 | KU39_ESK96614.1_SDR |
| PKS16 | 207 | NW_006767437_-_cystathionine_beta-synthase_CDS |
| | 208 | NW_006767437_-_hypothetical_protein_1_CDS |
| | 209 | NW_006767437_-_hypothetical_protein_2_CDS |
| | 210 | NW_006767437_-_hypothetical_protein 3 CDS |
| | 211 | NW_006767437_-_Pkinase-domain-containing_protein_CDS |
| PKS17 | 212 | KU43_KIJ60838.1 |
| | 213 | KU43_KIJ60843.1_P450 |
| | 214 | KU43_KIJ60845.1 |
| | 215 | KU43_KIJ60839.1_isoprenylcysteine_carboxyl_methyltransferase |
| | 216 | KU43_KIJ60847.1_isoprenylcysteine_carboxyl_methyltransferase |
| | 217 | KU43_KIJ60848.1_ABC_transporter |
| | 218 | KU43_KIJ60844.1 |
| | 219 | KU43_KIJ60846.1_P450 |
| | 220 | KU43_KIJ60842.1 |
| | 221 | KU43_KIJ60840.1_ABC_transporter |
| | 222 | KU43_KIJ60837.1_P450 |
| | 223 | KU43_KIJ60841.1_P450 |
| | 224 | KU43_KIJ60886.1_PKS |
| PKS18 | 225 | SU62_EFR04826.1_hypothetical_protein |
| | 226 | SU62_EFR04827.1_fatty-acid-CoA_ligase |
| | 227 | SU62_EFR04828.1_pks |
| | 228 | SU62_EFR04829.1_esterase |
| PKS19 | 229 | SU64_EOA86426.1_YfhR_like |
| | 230 | SU64_EOA86427.1_ER |
| | 231 | SU64_EOA86425.1_FAD-hydroxylase |
| | 232 | SU64_EOA86421.1_Drug_resistance_transporter |
| | 233 | SU64_EOA86423.1_OMT |
| | 234 | SU64_EOA86422.1_pks |
| | 235 | SU64_EOA86424.1_esterase |
| PKS2 | 236 | CS163GC1_CDS1_serine_hydrolase |
| | 237 | CS163GC1_CDS2_p450 |
| | 238 | CS163GC1 CDS3 PKS |
| | 239 | CS163GC1_CDS4_short_chain_dehydrogenase |
| | 240 | CS163GC1_CDS_FAD_dehydrogenase |
| PKS20 | 241 | SU65_EFQ95559.1_BLA |
| | 242 | SU65_EFQ95560.1 PKS |
| | 243 | SU65_EFQ95561.1_hyp |
| | 244 | SU65_EFQ95562.1_KR |
| PKS21 | 245 | SU67_EXJ61964.1_drug_resistance_transporter |
| | 246 | SU67_EXJ61965.1_scytalone_dehydratase |
| | 247 | SU67_EXJ61966.1_versicolorin_reductase |
| | 248 | SU67_EXJ61967.1_AMP_ligase |
| | 249 | SU67_EXJ61968.1_hypothetical_protein |
| | 250 | SU67_EXJ61969.1_FAD_monooxygenase |
| | 251 | SU67_EXJ61970.1_pks |
| | 252 | SU67_EXJ61971.1_metallo_BLA |
| | 253 | SU67_EXJ61972.1_hyp |
| | 254 | SU67_EXJ61973.1_SDR |
| | 255 | SU67_EXJ61974.1_AifR_reg |
| PKS22 | 256 | SU68_GAM43180.1_beta-lactamase_family_protein |
| | 257 | SU68_GAM43181.1_NAD-dependent_epimerase_dehydratase |
| | 258 | SU68_GAM43183.1_oxidoreductase |
| | 259 | SU68_GAM43185.1_benzoate_4-monooxygenase_ cytochrome_P450 |
| | 260 | SU68_GAM43187.1_scytalone_dehydratase |
| | 261 | SU68_GAM43176.1_riboflavin_biosynthesis_protein |
| | 262 | SU68_GAM43177.1_sugar_transport_protein |
| | 263 | SU68_GAM43178.1_short-chain_dehydrogenase |
| | 264 | SU68_GAM43179.1_pks |
| | 265 | SU68_GAM43182.1_halogenase |
| | 266 | SU68_GAM43184.1_NAD-dependent_epimerase_dehydratase |
| | 267 | SU68_GAM43186.1_SDR |
| PKS23 | 268 | SU70_ERF77218.1_SDR |
| | 269 | SU70_ERF77219.1_Fungal_TF |
| | 270 | SU70_ERF77220.1_p450 |
| | 271 | SU70_ERF77221.1_pks |
| | 272 | SU70_ERF77222.1_DABB_superfamily |
| | 273 | SU70_ERF77223.1_FAD_monooxygenase |
| | 274 | SU70_ERF77224.1_alcohol_DH |
| | 275 | SU70_ERF77225.1_OMT |
| | 276 | SU70_ERF77226.1_alcohol_DH |

TABLE 7-continued

| Description of gene sequences | | |
|---|---|---|
| Cluster ID NO. | SEQ ID NO. | Description |
| PKS24 | 277 | SU71_GAM40295.1_sulfhydrolase |
| | 278 | SU71_GAM40298.1_AMP_ligase |
| | 279 | SU71_GAM40299.1_MT |
| | 280 | SU71_GAM40301.1_carnosine_synthase |
| | 281 | SU71_GAM40303.1_carnitine_acetyl-CoA_transferase |
| | 282 | SU71_GAM40296.1_aminotransferase |
| | 283 | SU71_GAM40297.1_ammonia_lyase |
| | 284 | SU71_GAM40300.1_pks |
| | 285 | SU71_GAM40302.1_ABC_tranporter |
| PKS25 | 286 | SU72_ESK88623.1_pks |
| | 287 | SU72_ESK88624.1_carotenoid_cleavage_dioxygenase_1 |
| | 288 | SU72_ESK88625.1_long-chain-fatty-acid-ligase |
| | 289 | SU72_ESK88626.1_amino_acid_permease |
| PKS26 | 290 | SU73_KN817529.1_pks |
| | 291 | SU73_KN817529.1_hyp |
| | 292 | SU73_KN817529.1_AMP_ligase |
| | 293 | SU73_KN817529.1_8_amino_7_oxanoate_synthase |
| PKS27 | 294 | SU74_EMD35673.1_NAD_DH |
| | 295 | SU74_EMD35676.1_sulfhydrylase |
| | 296 | SU74_EMD35664.1_hyp |
| | 297 | SU74_EMD35669.1_halogenase |
| | 298 | SU74_EMD35663.1_AB_hydrolase |
| | 299 | SU74_EMD35666.1_alcohol_DH |
| | 300 | SU74_EMD35667.1_Drug_resistance_transporter |
| | 301 | SU74_EMD35668.1_hyp |
| | 302 | SU74_EMD35670.1_P450 |
| | 303 | SU74_EMD35665.1_hyp |
| | 304 | SU74_EMD35671.1_pks |
| | 305 | SU74_EMD35672.1_hyp |
| | 306 | SU74_EMD35674.1_hyp |
| | 307 | SU74_EMD35675.1_hyp |
| PKS28 | 308 | SU75_ESK88629.1_pks |
| | 309 | SU75_ESK88630.1_drug_resistance_subfamily |
| | 310 | SU75_ESK88631.1_hypothetical_protein |
| | 311 | SU75_ESK88632.1_dead-box protein abstrakt |
| | 312 | SU75_ESK88633.1_hyp |
| | 313 | SU75_ESK88634.1_nadh-ubiquinone_oxidoreductase |
| PKS3 | 314 | AK_C24701GC76_CDS1_class_II_aminotransferase |
| | 315 | AK_C24701GC76_CDS2_p450 |
| | 316 | AK_C24701GC76_CDS3_PKS |
| | 317 | AK_C24701GC76_CDS4_ferric_chelate_reductase |
| | 318 | AK_C24701GC76_CDS5_DUF4243 |
| PKS4 | 319 | KU27_AN22_1464_esterase |
| | 320 | KU27_AN22_1465_PKS |
| | 321 | KU27_AN22_1466_hyp |
| | 322 | KU27_AN22_1467_A_TD |
| | 323 | KU27_AN22_1468_hyp |
| | 324 | KU27_AN22_1469_amino_oxidase |
| PKS5 | 325 | KU28_TT08_2721_AK_reductase |
| | 326 | KU28_TT08_2722_ABC_transporter |
| | 327 | KU28_TT08_2723_esterase |
| | 328 | KU28_TT08_2724_PKS |
| | 329 | KU28_TT08_2725_sugar_transport |
| PKS6 | 330 | KU30_TV43_5580_esterase |
| | 331 | KU30_TV43_5581_P450 |
| | 332 | KU30_TV43_5582_PKS |
| | 333 | KU30_TV43_5583_OMT |
| | 334 | KU30_TV43_5584_P450 |
| PKS7 | 335 | KU31_KFY69032.1_P450 |
| | 336 | KU31_KFY69033.1_hyp |
| | 337 | KU31_KFY69034.1_esterase |
| | 338 | KU31_KFY69035.1_P450 |
| | 339 | KU31_KFY69036.1_PKS |
| | 340 | KU31_KFY69037.1_glycoside_hydrolase |
| | 341 | KU31_KFY69038.1_thymine_dioxygenase |
| PKS8 | 342 | KU32_KEZ41287.1_nucleotidyltransferase |
| | 343 | KU32_KEZ41288.1_OMT |
| | 344 | KU32_KEZ41289.1_AB_hydrolase |
| | 345 | KU32_KEZ41290.1_mito_phos_carrier |
| | 346 | KU32_KEZ41291.1_hyp |
| | 347 | KU32_KEZ41292.1_crotonyl_CoA_reductase |
| | 348 | KU32_KEZ41293.1_PKS |
| | 349 | KU32_KEZ41294.1_Drug_resistance_transporter |
| | 350 | KU32_KEZ41295.1_NADB_monoxygenase |

TABLE 7-continued

Description of gene sequences

| Cluster ID NO. | SEQ ID NO. | Description |
|---|---|---|
| PKS9 | 351 | KU33_KJK75348.1_alkaline_serine_hydrolase |
| | 352 | KU33_KJK75349.1_LysM_containing_protein |
| | 353 | KU33_KJK75350.1_PKS |
| | 354 | KU33_KJK75351.1_drug_resistance_transporter |
| | 355 | KU33_KJK75352.1_phytanoyl_CoA_dioxygenase |
| | 356 | KU33_KJK75353.1_SDR |
| | 357 | KU33_KJK75354.1 amino-7_oxonolate_synthase |
| SU61 | 358 | SU61_ENH82084.1_choline_oxidase |
| | 359 | SU61_ENH82085.1_fungal_specific_transcription_factor |
| | 360 | SU61_ENH82086.1_short-chain_dehydrogenase |
| | 361 | SU61_ENH82087.1_hypothetical_protein |
| | 362 | SU61_ENH82088.1_hypothetical_protein |
| | 363 | SU61_ENH82089.1_pks |
| | 364 | SU61_ENH82090.1_esterase |
| | 365 | SU61_ENH82091.1_ABC_multidrug_transporter_mdr1 |
| | 366 | SU61_ENH82092.1_cytochrome_b5_type_b |
| | 367 | SU61_ENH82093.1_sulfite_reductase_subunit_alpha |
| SU63 | 368 | SU63_KJZ74253.1_hyp_signalling_protein |
| | 369 | SU63_KJZ74254.1_mtRNA_formyl_transferase |
| | 370 | SU63_KJZ74255.1_esterase |
| | 371 | SU63_KJZ74256.1_PKS |
| | 372 | SU63_KJZ74257.1_choline_DH_halogenase |
| SU66 | 373 | SU66_EMF17384.1_ras-domain-containing_protein |
| | 374 | SU66_EMF17385.1_phosphoinositide_phosphatase |
| | 375 | SU66_EMF17387.1_hypothetical_protein |
| | 376 | SU66_EMF17389.1_versicolorin_reductase |
| | 377 | SU66_EMF17390.1_scytalone_dehydratase |
| | 378 | SU66_EMF17386.1_pks |
| | 379 | SU66_EMF17388.1_Metallo-hydrolase_oxidoreductase |
| | 380 | SU66_EMF17391.1_StcQ-like_protein |
| SU69 | 381 | SU69_KFY04761.1_aldehyde_oxidase |
| | 382 | SU69_KFY04762.1_SDR |
| | 383 | SU69_KFY04763.1_hyp |
| | 384 | SU69_KFY04764.1_reg_protein |
| | 385 | SU69_KFY04765.1_OMT |
| | 386 | SU69_KFY04766.1_metallo_BLA |
| | 387 | SU69_KFY04767.1_pks |
| | 388 | SU69_KFY04768.1_FAD-linked_oxidase |
| TC1 | 389 | Tv86_130_CDS |
| | 390 | Tv86_132_CDS |
| | 391 | Tv86_133_CDS |
| | 392 | Tv86_134_CDS |
| | 393 | Tv86_135_ORF |
| | 394 | Tv86_136_CDS |
| | 395 | Tv86_137_CDS |
| TC10 | 396 | KU19_SH16_10821_Cyclase |
| | 397 | KU19_SH16_10820_P450 |
| | 398 | KU19_SH16_10822_P450 |
| | 399 | KU19_SH16_10823_AK_reductase |
| | 400 | KU19_SH16_10819_QacA_MFS |
| TC11 | 401 | KU_20_SH18_11663_Cyclase |
| | 402 | KU_20_SH18_11664_P450 |
| | 403 | KU_20_SH18_11665_P450 |
| | 404 | KU_20_SH18_11662_P450 |
| | 405 | KU_20_SH18_11660_NMT |
| | 406 | KU_20_SH18_11661_MFS |
| TC12 | 407 | KU21_DS19_7112_Cyclase |
| | 408 | KU21_DS19_7113 P450 |
| | 409 | KU21_DS19_7108 P450 |
| | 410 | KU21_DS19_7109 MT |
| | 411 | KU21_DS19_7111_GMC_oxido |
| | 412 | KU21_DS19_7114_AK_reductase |
| | 413 | KU21_DS19_7110_Hyp |
| TC13 | 414 | KU22_DDJM14_6568_Cyclase |
| | 415 | KU22_DDJM14_6570_P450 |
| | 416 | KU22_DDJM14_6567_OMT |
| | 417 | KU22_DDJM14_6565_MT |
| | 418 | KU22_DDJM14_6564_MT |
| | 419 | KU22_DDJM14_6562_P450 |
| | 420 | KU22_DDJM14_6563_MT |
| | 421 | KU22_DDJM14_6561_GST |
| | 422 | KU22_DDJM14_6569_V-type_ATPase |
| | 423 | KU22_DDJM14_6566_TF |

TABLE 7-continued

| Description of gene sequences | | |
|---|---|---|
| Cluster ID NO. | SEQ ID NO. | Description |
| TC2 | 424 | Tv83_13_CDS |
| | 425 | Tv83_14_CDS |
| | 426 | Tv83_15_CDS |
| | 427 | Tv83_16_CDS |
| TC3 | 428 | BFT4_1_FAD_binding_domain_protein |
| | 429 | BFT4_2_Aldo_keto_reductase_oxidoreductase |
| | 430 | BFT4_3_cytochrome_P450 |
| | 431 | BFT4_4_UbiA_cyclase |
| | 432 | BFT4_6_hyp_protein_4 |
| | 433 | BFT4_7_hyp_protein_5 |
| | 434 | BFT4_8_hyp_protein_6 |
| | 435 | BFT4_10_FAD_FMN_isoamyl_alcohol_oxidase |
| | 436 | BFT4_11_hyp_protein_8 |
| | 437 | BFT4_14_hyp_protein 11 |
| | 438 | BFT4_15_glutathione_S_transferase |
| | 439 | BFT4_16_D_isomer_specific_2_hydroxyacid_dehydrogenase |
| TC4 | 440 | KU11_FM3_3034_Cyclase |
| | 441 | KU11_FM3_3033_P450 |
| | 442 | KU11_FM3_3032_P450 |
| | 443 | KU11_FM3_3031_FAD |
| | 444 | KU11_FM3_3037_Hydrox |
| | 445 | KU11_FM3_3027_AMP_SDR |
| | 446 | KU11_FM3_3030_PHOS |
| | 447 | KU11_FM3_3035_Hyp |
| TC5 | 448 | KU12_HI6_11661_Cyclase |
| | 449 | KU12_HI6_11655_P450 |
| | 450 | KU12_HI6_11638_P450 |
| | 451 | KU12_HI6_11667_AMP_ligase |
| | 452 | KU12_HI6_11646_monocarbox_MFS |
| | 453 | KU12_HI6_11632_MFS |
| TC6 | 454 | KU13_CeS8_5906_Cyclase |
| | 455 | KU13_CeS8_5905_P450 |
| | 456 | KU13_CeS8_5911_P450 |
| | 457 | KU13_CeS8_5904_choline_DH |
| | 458 | KU13_CeS8_5910_halogenase |
| | 459 | KU13_CeS8_5907_AMP_ligase |
| | 460 | KU13_CeS8_5909_superoxide_dismutase |
| | 461 | KU13_CeS8_5908_MFS |
| | 462 | KU13_CeS8_5912_MFS |
| TC7 | 463 | KU15_DS54_10337_Cyclase |
| | 464 | KU15_DS54_10336_P450 |
| | 465 | KU15_DS54_10340_P450 |
| | 466 | KU15_DS54_10341_P450 |
| | 467 | KU15 DS54_10338_polyprenyl_synthetase |
| | 468 | KU15_DS54_10333_GMC_oxido |
| | 469 | KU15_DS54_10334_GMC_oxido |
| | 470 | KU15_DS54_10339_Hyp |
| | 471 | KU15_DS54_10335_Hyp_transmembrane |
| TC8 | 472 | KU16_PO11_11845_Cyclase |
| | 473 | KU16_PO11_11844_FAD_oxidase |
| | 474 | KU16_PO11_11843_P450 |
| | 475 | KU16_PO11_11841_2_P450 |
| | 476 | KU16_PO11_11840_FAD_oxidase |
| | 477 | KU16_PO11_11847_FAD_oxidase |
| | 478 | KU16_PO11_11846_SDR |
| | 479 | KU16_PO11_11848_AMP_ligase |
| | 480 | KU16_PO11_11839_AMP_ligase |
| TC9 | 481 | KU17_SC18_16687_Cyclase |
| | 482 | KU17_SC18_16686_P450 |
| | 483 | KU17_SC18_16688_SDR |

While preferred embodiments of the present disclosure have been shown and described herein, those skilled in the art will understand that such embodiments are provided by way of example only. Numerous variations, changes, and substitutions will now occur to those skilled in the art without departing from the disclosure.

SEQUENCE LISTING (489 sequences)

SEQ ID NO: 1 - DNA, 500 bp, Saccharomyces cerevisiae
tatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaaaggcagaggagagcatagaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacaca

SEQ ID NO: 2 - DNA, 500 bp, Saccharomyces cerevisiae
ataggaaaaaaccgagcttcctttcatccggcgcggctgtgttctacatatcactgaagctccgggtattttaagttatacaagggaaagatgccggctagactagcaagttttaggctgcttaacattatggataggcggataaagggcccaaacaggattgtaaagcttagacgcttctggttggacaatggtacgtttgtgtattaagtaaggcttggctggggatagcaacattgggcagagtatagaagaccacaaaaaaaaggtatataagggcagagaagtctttgtaatgtgtgtaacttctcttccatgtgtaatcagtatttctacttacttcttaaatatacagaagtaagacagataaccaacagcctttcccagatatacatatatatctttatttcagcttaaacaataattatatttgtttaactcaaaaataaaaaaaaaaaaccaaactcacgcaactaattattccataataaaataacaac

SEQ ID NO: 3 - DNA, 500 bp, Saccharomyces cerevisiae
ccattgggccgatgaagttagtcgacggatagaagcggttgtcccctttcccggcgagccggcagtcgggccgaggttcggataaattttgtattgtgttttgattctgtcatgagtattacttatgttctctttaggtaaccccaggttaatcaatcacagtttcataccggctagtattcaaattatgacttttcttctgcagtgtcagccttacgacgattatctatgagctttgaatatagtttgccgtgattcgtatctttaattggataataaaatgcgaaggatcgatgacccttattattatttttctacactggctaccgatttaactcatcttcttgaaagtatataagtaacagtaaaatataccgtacttctgctaatgttatttgtcccttatttttcttttcttgtcttatgctatagtacctaagaataacgactattgttttgaactaaacaaagtagtaaaagcacataaaagaattaagaaa

SEQ ID NO: 4 - DNA, 500 bp, Saccharomyces cerevisiae
atttattgaaaagtaaatatctcgtaacccggatgctttgggcggtcgggttttgctactcgtcatccgatgagaaaaactgttcccttttgccccaggtttccattcatccgagcgatcacttatctgacttcgtcactttttcatttcatccgaaacaatcaaaactgaagccaatcaccacaaaattaacactcaacgtcatctttcactaccctttacagaagaaaatatccatagtccggactagcatcccagtatgtgactcaatattggtgcaaaagagaaaagcataagtcagtccaaagtccgcccttaaccaggcacatcggaattcacaaaacgtttctttattatataaaggagctgcttcactggcaaaattcttattatttgtcttggcttgctaatttcatcttatcctttttttcttttcacacccaaatacctaacaattgagagaaaactcttagcataacataacaaaaagtcaacgaaaa

SEQ ID NO: 5 - DNA, 500 bp, Saccharomyces cerevisiae
caaaaaaacaatggaagaacaaagaaaatttagcggaagtaaaaataacagccgaaagccaaattcaggcttatcttgcctactctttcttttatcgaattcctttaggccgttgcaatagaaaagtaataaaaacgcatatacgtaagttgtagtcagtgtaattgcaatctattatgcgcatcaggtgcgcatactacatccattggtgcacaaaaaaaggaacgcagacaagaaaattattcagtttgctgttcgtgatgagccatccctgaatatgactaatgttaatgttcaatttgggatcttatttttttttgtgcagtaataagaatctttgaaaaaaaactatataagcctatatagtttgtaagatataagacaaaacacacctgcttttccactacacattttcgttattatataaaaaagacagccaagtatacttgtcaacaaaataaactcatagcaattacactataaaaacaatagcatcaaaa

SEQ ID NO: 6 - DNA, 500 bp, Saccharomyces cerevisiae
tggcaatcccctccgatcgtccgcggcaaaatggtcgtcaatcggacaaagggggatgatgggatctggtaatagaagaaaatatggactaaaggtagccgctaaagcgatccaggcatgtgttgccaatgatgtaagtcaagcgaaggaaatggttcagtaatatgatagacagactgcacttcaagggtgcgccccctcccccgcgcatatgcttacaacgcaaaataattgacgtttaatgtggatacttatcgtaatcgctgcattatagatttcgagtcatgttcacttaaccccacatatttatatagaacgcatcttcaaagtacttataaagtttagttttacatttttctgctttctatttcttctttttcggttcttcttcatgccagttggcatggcttaagagctttacttgtcgcttttatttaaaaccttctctcgggagaagacaattgttgatatacagtaattgtatttgcattatcactgct

SEQ ID NO: 7 - DNA, 344 bp, Saccharomyces cerevisiae
aacgtctatctatttatttttataactccgggatgtcattgccggtggtccgaaaatcggcaaataaggaaataagggaagaatatgcagtagtcaaatcatcagtgttctctttgatacctttcagggctaggaatagtgggggtggagtataatatcaaaaaccggacttaacattattggttcggttggaattggctataggcaaactagtctccggcatgatatataaatgacagcctgcaattgtatgttactacactcttgacttgtcgactacagtcgctgctcaggcacgagaataggaggtaagaaggtaacgtacgtatatatataaaatcgta

SEQ ID NO: 8 - DNA, 500 bp, Saccharomyces cerevisiae
gagctccgtggaataggcgagcggctgagtggttctccaagctacggtttttacgtgtagccccatgtgagcaagccaaacaagggcccttaaaggcgtgactacaaaaaggggcgggttggaaggtcatctgcagcgagatacgaaaagattttttgccagatttgcggttgggcggctatttcggtattgttggggtaacaaacgttggggaagactgcattttcttacagctttttttcgttatcgcgggttgggcggctatggcgccttctcctctgtactccaacctgtcagagacaccaagctgtatataaagcaccttggttggatcgtatttccctgagatcttgctataggttcattttatatatcgtccaatagcaataacaatacaacagaaactactagcatctgtttataagaaaaaggcaaatagtcgacagctaacacagatataactaaacaaccacaaaacaactcatatacaaacaaataat

SEQ ID NO: 9 - DNA, 500 bp, Saccharomyces cerevisiae
ccctatctttttttttttctcgcaatctggggaaagcttttctcatgcttatacgtgatttgttatataagggattgctatttcaggcatcattcacctccttttgtatccttagtttcactgcatttgatatatatatatacgtatctgtagtttccttccattacataacgcataatatactatttccatagtctatcttacatcttttttcttacttttgttaaggaacggataacgataaaacaaaaagagagatttaagattacttctgtaacttttttgatccattaccaaaactatattttttttcttttctctcctctggcattaaacacagttattgctacagctaatcatcgatataataatacatcacattaactgtctataagaggctggtacttagtagatggtgagaattttttatttttgtattttaacttcatttttgtaaacaagttggaactggaacttactatagaacaagagcttaaacc

SEQ ID NO: 10 - DNA, 500 bp, Saccharomyces cerevisiae
gttgtatcctattggatcacgggcgacggacaagacccgaagtgcggaccggcatggtcagcttgcacggaagctttaagggtttcccttgtttcggcattagaagaggcatttcgcacgttttaccgggtcagaaacttcgaggaagctgtgacaattggaaaaaaaggcaaaactaaatgcaatgtatccggttgcccatgcattatttgtgatgttttcggatgtagttcgctgcgctccgcggcgatatatcctctagcgagaggcatatgtataaatatatatatatatatctaacaaaagcattcaagtttctttctctggtgttacgtctttgttcgactttctctgcttacagccctgtatgaccaaagaaaaaataaaaagacagctacataccagcagaaattttttatagtattacactatacatccaagttttttcacaattatttattgtttttctcacatagaaaattccgcatactgcgattata

SEQ ID NO: 11 - DNA, 500 bp, Saccharomyces cerevisiae
gaaagcttattactgagttttgcggagcatcgctcggagcggcggaattgaatcgaaccgccgtgctattaccgaacaaaaaaattcgaaagcataaactcagtagtgaaaaacttgagaattttcagatgagtggcgactttccagtccttgcggttttgtcaccttagtcagctagtaaggaggccgtgtgggttagagtggctacaatcctcaaagggcacttctagaacccacggtgaattttttttggcatgataaatcggtagaatcggtgaagtaattacccaaaaaaggatcgggattgtgtttctcgtaattccgtattattgccgatggcatcgactacttcttttttcagaaaccccaacaagggtctattgtaattgtatataaacctttttgtaatggatatatacatgtggtactatttctcctcatcctgctccatcgaaaatcctcatacgaagagttaggaaagcaaagaaaacaacaaaaac

SEQ ID NO: 12 - DNA, 412 bp, Saccharomyces cerevisiae
agacacaatgcgaaaaatcgcgcagggacataatttttgttttcattattctttcgcttattccctccgttagctccaccgcttttttgattggaatttcctttcggcaatggctttccggttaccacgcctcgggtttcgcatcccgaaaagcatatctacacaagaaaaatgaatgataaacaattgatgagtggcgctatttcccttatcatctcattattgtacttagtatcgtctattatcaggagaaatcgcatgaactaagcccattttctcacccttctgccttcttatataaagcttgctgggaaccgaacacaaactccacaagtccgtagcagctcttctcttttgtcttttatatatcataaacatcgctacatagtaataacactaacgcacgctagaa

SEQ ID NO: 13 - DNA, 500 bp, Saccharomyces cerevisiae
aggggtagcggctttttcatcaactcgattattaccctttagagaccttccctaaagtgagcggcaattatttccggatgttagtagggtaatatggttacggatttgtgacacaaaagggcttttcaacagtcggtctgggttgaaggattttcaggatgacgaagctttcaataagagggactggactgttaacgcggggaattataggttactttccttgatctggctctggctctggctctgattttggctcttgtactcctcggacttcttgacttgtaacgaaatacgtcttttgtccttctcttcttcttccatagtaggggcgaatgaggggagcatagtggatccttctaaccatctagaatggggtggacaacatataaaagaagagcaatcttgcagcgcagtcatatttatgctaagtatatcattatttcttgctagcgtaagtcataaaaaataggaaataatcacatatatacaagaaattaaat

SEQ ID NO: 14 - DNA, 500 bp, Saccharomyces cerevisiae
agcctagtcccggtaaaccgcaaacggaccttaattgtgacgaagggcccaaatttgatgggtcggtgttaatgattagtcctcattgtcataataaagtgtgatgatggaggcaatgatgatatacggtagtactactgctcgaggtgctatcttttaaccaatcctttgagattcttgtcgccacggagttactaccttttacaaaccgtaatgtcacattttgcatatatcttatgtataaatatatagttcacttactacttgttctcgttttgttaactttcttgttgtagttcttcttgttcttggcgtttccccctttgttttctatctgcttcataagtaaagtgcaaagcattttggaagatattatcaattgagtcattgaaagaaacttggcatcttccctattactaaaactaagaatacttgattcaagaaagaagtttatattagttttagccgtaagataacataacaaagaagaagaaagaaaa

SEQ ID NO: 15 - DNA, 500 bp, Saccharomyces cerevisiae
tcgatcagctccaattaaatgaagactattcgccgtaccgttcccagatgggtgcgaaagtcagtgatcgaggaagttattgagcgcgcggcttgaaactatttctccatctcagagccgccaagcctaccattattctccaccaggaagttagtttgtaagcttctgcacaccatccggacgtccataattcttcacttaacggtcttttgcccccccttctactataatgcattagaacgttacctggtcatttggatggagatctaagtaacacttactatctcctatggtactatcctttaccaaaaaaaaaaaaaaaaaaaaaaaaaaaaaaatcagcaaagtgaagtaccctcttgatgtataaatacattgcacatcattgttgagaaatagttttggaagttgtctagtccttctcccttagatctaaaaggaagaagagtaacagtttcaaaagtttttcctcaaagagattaaatactgctactgaaaat

SEQ ID NO: 16 - DNA, 500 bp, Saccharomyces cerevisiae
acatagtactgtacgattactgtacgattaatctatccacttcagatgttcaacaattccttttggcattacgtattaatacttcataggatcggcaccctcccttaagcctcccctaaatgctttcggtacccctttaagacaactatctcttaaccttctgtatttacttgcatgttacgttgagtctcattggaggtttgcatcatatgtttaggtttttttggaaacgtggacggctcatagtgattggtaaatgggagttacgaataaacgtatcttaaagggagcggtatgtaaaatggatagatgatcatgaatacagtacgaggtgtaaagaatgatgggactgagagggcaattatcatccctcagaatcaacatcacaaacatatataaagctcccaattctgccccaaagttttgtccctaggcatttttaatctttgtatctgtgctctttactttagtagaaaggtatataaaaaagtatagtcaag

SEQ ID NO: 17 - DNA, 488 bp, Saccharomyces cerevisiae
aagttcttgactacccctatctcacactagtacgtaattcaatgtatcattcgtattgtaagtagatagagacgcaatacaggaaagctgaccttccttccaatcaccacggctgaaatgctttgttgaccaattacggacgcttaagagcggacgcggctggaacggctccatcctaaatcggcggagggagaactccgataccagccgacatggcaataatagtgacagtagatgctaccagccccgcaataatttcacagtagatcatcaacagtctcctcatttctggaaatgatcagcaacttcgacggatttaactctcaagcagttacgcactccgagaacagccgtgatcatctttgaacaagcaaaatatataaagcaggagaactgtcctacctagagctagaatagccataactaactatgtaacattctacagatcaatcaaaaacaatcttcaatcacagaaaaaaataaaaggc

SEQ ID NO: 18 - DNA, 329 bp, Saccharomyces cerevisiae
ttttctagttcttcttctgcaatattgccttttgggaagaaggatcgaaagtagccatttgcagacacgtttttactatatttactgtatcttcgattgcgcggctaaagttgccatattattattatattgcagctcaaccccgcatttccggagttttctttttttttatttggggtaatttggaggtcggcggctattggtgggccggaaatggtgacacacttgtaatatataaggaggaaatcctacatgtgtataagcgaaatcacaaggataataatgtattgctaaacaccctcaagaaagaaaataatcataacgaaatc

SEQ ID NO: 19 - DNA, 500 bp, Saccharomyces cerevisiae
cggatggaatcgccgcttttgaattcacctccggggtattattattattcttagtagtcgcggtcgtgcggacacccggagttatgcgggcccgaaagctcattatgtagtaaagctaggtaatgttaagggcgtaagagccaacgcaaggcagcaatagcctggtattcccacatatcaagaaagcttaaaaagttgagacagggaatttgaaggcgaagattgccgaactggccaatacccactactttttttttggtttgcttggtttcttcctgtcgcttgccaacttgtggcatcttccccacactatattataaggatcgtcctatgtataggcaatattatccatttcactcgctaacaaatgtacgtatatatatggagcaacaagtagtgcaattacagacgtgtattttgtcttgatcttgctttttgtatgataggcctaagaataacagtgcgaacatataagaaacatccctcatactaccacacat

SEQ ID NO: 20 - DNA, 500 bp, Saccharomyces cerevisiae
agaccttttttttctttttctgctttttcgtcatccccacgttgtgccattaatttgttagtgggcccttaaatgtcgaaatattgctaaaaattggcccgagtcattgaaaggctttaagaatataccgtacaaaggagtttatgtaatcttaataaattgcatatgacaatgcagcacgtgggagacaaatagtaataatactaatctatcaatactagatgtcacagccactttggatccttctattatgtaaatcattagattaactcagtcaatagcagattttttttacaatgtctactgggtggacatctccaaacaattcatgtcactaagcccggttttcgatatgaagaaaattatatataaacctgctgaagatgatctttacattgaggttattttacatgaattgtcatagaatgagtgacatagatcaaaggtgagaatactggagcgtatctaatcgaatcaatataaacaaagattaagcaaaa

SEQ ID NO: 21 - DNA, 500 bp, Saccharomyces cerevisiae
tccgaagagcgtgctaccaattcttcatctcgttaacaaactggttctccgttaaaaattgtgctatatgtcctataagccaactctatctatatcttttcttttagtcctactttggatactgttaccaccattttagattgctttttcttttgccgctagccttacaatatttggcaaactttttttttttagccgccgagactcttgatctatggccgggcgaaagggcaaatgactgcttatccccgccatcacttccccccgcccaagggtttagaattggggattaagtaaaaacgaatgactattcctctcaaagtcatccttgttcgacaaaaagaatggaatataacatattggaacaatttcatcctcttttccccattttcgcatataagagcaactaaacgccggtgagtaaagtgcccttccctacagactcttttactcaggtatatatatatatatatcccttaaaaactaaaaagaaagcactc

SEQ ID NO: 22 - DNA, 310 bp, Saccharomyces cerevisiae
agcggttgttctaaccactatttaaagccgcaattagtaatgcaaaaagttggccggaattagccgcgcaagttggtggggtcccttaatccgaaaaaggacggctttaacaaatataaactccgaaaatccccacagtgacagaattggagaaacaaccagttttgatatcgccatacatataaagagatgtagaaagcattcttcactgtaatgtccaaatcgtacatttgaatttcttgtaggtttatttaaaaggtaagttaaataaatataatagtacttacaaataaatttggaaccctagaag

SEQ ID NO: 23 - DNA, 340 bp, Saccharomyces cerevisiae
aatttttattttctccttccatatgagcgacagcggttactagccgctgtcctcaggttaatgatccaagtccgagatccgggccgaatatgcttgcggggaaagaaataaaagtgcattggagaagaaaaggatatgctcttcaattagaagcgccgaaacactaacatcatgctagcgatatcatacgtacactatataatgtaaaaaatgggcttaagaataactctcttatttcttaacttttgttgcggttgaagagcttataaaagtactagtggcctaaagaagctacagcgccgataataatatcgatttcgacttttctagtatttcgccg

SEQ ID NO: 24 - DNA, 500 bp, Saccharomyces cerevisiae
tgtgcacatacgtccagaatgatatcaagataaatggcacgtgtatgtacggctgtgtaaatatgataatcatctcggacgaacggcgtagcactctccatcccctaaaaatgttcacgtgtgactgctccatttcgccggatgtcgagatgacccccccccctcaaaaggcactcacctgttgacatgccgtggcaaatgattggggtcatcctttttttctgttatctctaagatccaaagaaaagtaaaaaaaaaaggttggggtacgaattgccgccgagcctccgatgccattattcaatgggtattgcagttggggtacagttcctcggtggcaaatagttctcccttcattttgtatataaactgggcggctattctaagcatatttctcccttaggttatctggtagtacgttatatcttgttcttatattttctatctataagcaaaaccaaacatatcaaaactactagaaagacattgcccactgtgct

SEQ ID NO: 25 - DNA, 500 bp, Saccharomyces cerevisiae
aatataaataaaattccatacagcatgtctaatcatagctaatttatacatattcatcatgaaaacatataggggaaaatatggtcggttaacacacctatcaaaaaattattcagcaattccaatctcgttagtaaaatatattcttattttttttttttttctctgattgtattatttctggagttttgacttatttttttaccacatcgcgcttttcgtccccaatctctctgatatatgatgctgtctataggtagccacttccccgatgtcggacctcgggccgtttacaaactttattgagatgaccttatttctccacattctagtcattcaacttttaccctcatatgtttaccttcactaatgtgaaagcatgaccaaagaaagtgtataaggtatataaatctgccataatgtatgtataacttattaggactttctcaaatagtattttggtattttctactgttctctgatgatcgagagcaaacaga

SEQ ID NO: 26 - DNA, 500 bp, Saccharomyces cerevisiae
aagtacgatatggtataactgtaacattgaaggactgaaggactgaaggactgaaggactatagtcaagggccaatggggaaggtcccttccaggccatttgcccgatagtttgtccttctcttgcttttccgacggcccgattgcatgtggcggggcagcactggataaaaaaacgtggggggagtgattaaatttatacgcttattgtgtcaacacggaaaccttatagttatcattactaacatcgcaacaagctgcttttttactcgtttttagccacaccataccccctttaattaactaataatgcataaaatagttattgcttcttgagttgcagcttcttcctggacgtactgttatatatggcatgtcttcgcatgtccgtcaaatttagcgttgtctcgaaacttaggctgtcgttcttgctgtctgtcttctgataaaataatatattggaataagaaaaaaaaaataggaacaagaaagtgtgtgaga

SEQ ID NO: 27 - DNA, 304 bp, Saccharomyces cerevisiae
atattattcagttgaaagacaaaaaaacataaatatttctatgagcaaacaatttgaacagaaaaataaaattggggaagtgacacaccatggtagcggttctaaagcgaaatcggcaaagcggctaaatagcagttttgatgacttactccacactgaaaatggatgaccttaaataggagataaagctttttcatccctatgtatttaagatgactggcttgtcaagcattctaatcataaaaaaaagatcgtatttgatcaagaatttatacatagacgccgctaaataattgaatacaaa

SEQ ID NO: 28 - DNA, 500 bp, Saccharomyces cerevisiae
ctcgtttgccgttacattgcattgatggtacaataaagggcatgctttatatcgagatgtttcagtgtatatgaggggaaacagaaaagagtcattcctgccattttttggtcactgctttttctgctatgagtaatggtgaagttccttgtggctacacgcttaatgtcatcgggttactgctcctaatatccgcatataagctttatgcagggatcagttgggcggctatttatctacacccagtcatccggcgtgactggatctccacttgccgcaataagtcggtggacaaatggagatttaagagtaaagatgcatgatggtataattcctttagtcgaaatagatatatttcaagcgcatatataggcagacgcttgtactgtagaaatagccgatattcaattgcgctctatgtgtgtttttattccaggttttccttggattctacgtattgtacgactttcttatcctccacaaacgtcatcgtgtcagta

SEQ ID NO: 29 - DNA, 500 bp, Saccharomyces cerevisiae
cccaacagatttcaagtctgtcgccttaaccactcggccatagtgcctaaaacaatgtaggttatttaagcaagtattgtagatacttttcgtaataaactacaatgcacccacgactcgcggtgtaatgatggcatgaaatcattgaacgaagttttgcggctatacggctgaaggacgagactaaagggacaggaattattaatgcggggtataatttgaatagtattaacgggcactgccgtttagccatcaaatgctattgttggggtattctctctactttttgttcttggcttgaaccttttcggcggttggcaatcgtccgtatataagcatcggctgtcccaatcctctattgcccttttcccttgcacctccttctcaattcttcgtatctttcgcgtaaaggtagatcttgattcacctatctgtcgaaacacgattaagtgcaaacgaaacaacgtacagtatataacaaagtattttaaataataaga

SEQ ID NO: 30 - DNA, 500 bp, Saccharomyces cerevisiae
gctatgacgtttgggtggcctagccggttcgcgtgtgcctgtcgcttttgtcgcttttcaacttctgcccgatatttcctatcaaaggaaaatgggacgttttcaacccctcgctatcatcgtgcctgcactctgcctatcgccaactacaccggggttttatctgcttcacccctccatccagtgctgataacaagaagaaccttgcagggtagggcaggacctacggccaaaatactaattatgtctgtttatgtacatgccccaatctgaatattccatgaatgtaggcacagcatatctccatccatgtactgatacagacgcataaacatatatgtatatacatacttatacactcgaatatttgtagactgatgtacttctatatatatatagggggtttgtgttcctcttcctttcctttttttttctctcttcccttccagtttcttttattctttgctgtttcgaagaatcacaccatcaatgaataaatc

SEQ ID NO: 31 - DNA, 500 bp, Saccharomyces cerevisiae
tagatgcgccatctccgagaaaaaatctagacaataacagcgacaattaacctaaagaggatagaagatcgagcaaaaaaatttttttaatatggggtcagtggcgatattatactataggagttaaagagtaagttgagtgtaaggtggtagaattatgattgaactccgaaactaagcgccgattatgggtggcaaagcggacagcttttgatatataatcgatcgctctcgtagttgatatcctctctcttgcttatcttttcctgtatatagtatatgtgtacatacagatacgaatatacctcagttagtttgttttaacattaaatattcaacagttgccagtagcaaaaagaatatatccattcatttcgagctttttcgtctcattactgatatccaactaacagtctcctcatagacggtaccttactttcctttaatattataatactagtatagtcgcacatacttaactcgtctctctctaacacata

SEQ ID NO: 32 - DNA, 500 bp, Saccharomyces cerevisiae
ctacgtcgcctgttcgagcggctctgttcgttgcatgaaactaaaataagcggaaagtgtccagccatccactacgtcagaaagaaataatggttgtacactgtttctcggctatataccgtttttggttggttaatcctcgccaggtgcagctattgcgcttggctgcttcgcgatagtagtaatctgagaaagtgcagatcccggtaagggaaacacttttggttcacctttgatagggctttcattggggcattcgtaacaaaaaggaagtagatagagaaattgagaaagcttaagtgagatgttttagcttcaattttgtccccttcaacgctgcttggccttagagggtcagaattgcagttcaggagtagtcacactcatagtatataaacaagccctttattgattttgaataattattttgtatacgtgttctagcatacaagttagaataaataaaaaatagaaaaatagaacatagaaagttttagacc

SEQ ID NO: 33 - DNA, 500 bp, Saccharomyces cerevisiae
gagctatagtcttttgcgctttcaatacgtgtagcggtgtaccaaaagttgcacaaaaatgtagttgtcaatgaaagcgcactacgtatataatgactattttttttttcctgggttgcatgggtaatttgttgttaatatgcgattttcttggggaaaagggtgtcatagcgccaaaaactgccgtgcggcacagtatgtatgtttttgagtcgcggcgtttaagggcttggcataaaaagtggttcaagcgagtgataagttgggcgaatgtcgtcttttttgtaaccatgtctttcctgaaaacaacctgtaggcagctccactccacataagggctttctccaatggcaatgggagctcggaacaccggagtagaaatttttataatgtgtattgtataaaacttgcttgttatgcagtttttgttttttttgttactcttccgtagcacaatagacatatattagcggcaaaattgtagtgttgcgattattgcc

SEQ ID NO: 34 - DNA, 500 bp, Saccharomyces cerevisiae
gtgtagtattgatcttgttggtattgctagaaatgcttcagcaatactgtataaaatatggaaacgttgccatggcaagacaaaagaagtgatcttgagtgaaataatagagcccggatggccgggtaaattcaaccgctcgtaccgtttataatacgcataaacgccgaaaatgtctctattttagtcattccccagagtgcggtattgcgtacacctgtcatgcgttccttagtgccgatagatatactaatatcgatgcgtcacagtagcagatcatctctgacacttgtttccccatttttttttttcattttttaaagggtttctctacagcctacaggcctcccctaataagtcagcccctccctttggagtgcgctgttgacctgcgtatataagaggtatatcagtgccagtaggtaaacccatcttgcggggattgtaccaggaacatagtagaaagacaaaaacaaccaccgtacttgccattcgtatag

SEQ ID NO: 35 - DNA, 500 bp, Saccharomyces cerevisiae
catcaattagggcaaacttgaatagtcagctaggtcatatatttaaaatcaattagccctatgactacattaggtttattgttaggtctttacggctgcatatttgctttcgccgttcggcggggtcctgcgacgatttctgcgcggtcttgtatgggtggagttgacagttaaccctccggaccccctaccccggtgtgcccccggtccatctatccattttgcggtaacccctttgcgcgacagctgcttatcaaggtacctggatcgagccataaaaattgatctacacagatgagatggggcattgggatatattattagtcggagtatcattatagttattcagttttatgcaggttactggccaaacgtttttcttcatttggaataatcgtttaggagctactgttccggtataaagtaacaagcacagtagcagagtaatacgcagtgacgataatagagactagtaaaacagtcgagttgtcggacctaaa

SEQ ID NO: 36 - DNA, 500 bp, Saccharomyces paradoxus
tagtcttatctaaaaattgcctttatagtccgtctctccagtcacggcctgtgtaactgattaatcctgcctttctaatcaccattctactgtttaattaagggattttgtcttcatcaacggcttccgcccaaaaaaaagtatgacgttttgcccgcaggcgtgaagctgcccatcttcacgggcctgacctcctctgccggaacaccggccatctccaactcataaattggagaaataagagaatttcagattttcagaggatgaaaaaaaaaaggtagagagcataaaaatggggttcactttttggcaaagttacagtatgcttattacatataaatagagtgccgataatggctttttttcatcttcgaaatacgcttgctactgctcttccagcgtttttattacttctttcttgtttctccttagtatataaaatatcaagctacaacaagcatacaatcaactgtcaactgtcaattatattataatacact

SEQ ID NO: 37 - DNA, 496 bp, Saccharomyces kudriavzevii
ctctcaaatcttttagcgccaaggactccaactaattgtatcttgaatttgcctttacgatccgtttgtccagtcacggcatgtatatcttattaatcctgcctttctaatcacgtattctaatgttcaattaagggattttatcttcatcaacggctcccacgcaaaaaatgacgttttgcacacagacacgaaatacaccttccaccggaacaacggccatctccaacttataagttggggaaataagacaatttcagacttcagagaatgaaaaaaaaaaaaggtacatcacagatggggttcaggtttgctacaattgcagggagcctgtcacatataaatagacctccagtgatgatatctttcagtcttcaaacgtctcttgtcacagttctggtcgttctatatcacatctctcttggttctacttattgtctataatatcaagctacagcaagcatacaatcaactatctaccataccataatacaca

SEQ ID NO: 38 - DNA, 500 bp, Saccharomyces bayanus
gatccagttctccagtgacacagcctttatctggtcaaacctttctttctaatcacctatgctgatgcttaattaagggatttttgtctccatcaacggcatgcgcccaaaaatgacgttttttttaacccatagacacgaaactacccattttccaccggcctgacctaccaccggaacaacggccatctccaacttgcaagttggggaaattaagagcatcgcaggtttaatggaagaaaaaaaaaaggtacagcacagcgcaaatggagttagttcccttatgtcacacactcacacacagtcggtcagatcaagcatactgggtgcgtataaatagagtggccattgccaccctgtttatctcaaaatctgtcttgttagtggtcttctccctttttcaggttacaattctcttgtttctacttagtatataagtatatcaagctatattaagcatactatcaactgtcaactctatcctcaaaatacaatacaaa

SEQ ID NO: 39 - DNA, 480 bp, Saccharomyces mikatae
tttcccaaaaagtattatttttaagtgataattgataaaaggggcaaaacgtagacgcaaataaaacggaaataatgattctcagaccttttagcgtcaagaactgcaactaatcttatcttaaaattatctttataatccgtttctcccgtcacagtctgtgtatctgattaatcctgcctttctaatcacctattctaatgttcaattaagggattttgtcttcaccaacggcttccacccaaaagtaaaaaatgacgttgtacccacagacatcttcaccggcctgacctgccaccggaacaacggccatctccaactcataaattggagaaataagagaatttcagattctggaggatgaaaaaaaaaaaggtacagcataaatggggttttatgtgggtacaattacactaggactatcacatataaatagacgggcaatgtaggttcttttccacccttgagacagagttattc

SEQ ID NO: 40 - DNA, 500 bp, Saccharomyces castellii
tgtcgtggacgaaatacgccacaattttgccgagaaggtcattagtatgtccaagaaaccctaggtgtaaagtcgggaaatccgaatctccgattttggaggggcccatgccctactttttttcgccaggggtgaaattccaaacccgtgcgcgttcttggaatttgacagcgcattgagtatgtgctgcgtattcccactatcatgacgcgccctttatctgggaaaaatggaactggatgctgaaatatttcactctcagatcacatatcccaaatcctgtgagtgaattgtttggtcaggcgaccaaacaggaatatggaatagattctattctctggattctacaattatccattgttagcaaaacaaaaaaaactggtggtatatatattcagagcctaaaatttaaaggttggatctcaattttaaaagttttcattctgttttgtttttgtttcttcttagctcacgaataaccaaacaaaaaacaatcaata

SEQ ID NO: 41 - DNA, 500 bp, Saccharomyces paradoxus
caataggaaaaaaccaagcttcctttcatccggcacggctgtgttgtacatatcactgaagctccgggtattttaagttatacaagagaaatatgcgggctagactagcaagattctggactgtataacgttgtggataggcggataaagggcccaaacaggattgtaaagcttagacgcctctggttgggcaatggcatgtttgtgtattaagtaagacttggctgcgggatagcaaaactgagcagaatatagaaggccacaaaaaaaaggtatataagggcagcaaagtctttataatatatgtagattctcttctctgtgtaattcattcttgtgcttaccactcaaatatacagaagtaagacagataaccaacagcctttcccagatatacatatatctcattgtttcagtttaaacaataatcatatttgtttaactcaaaaataaaaaaaaactaaactcactcaatcaatcattccataaaaaaaaacaat

SEQ ID NO: 42 - DNA, 500 bp, Saccharomyces kudriavzevii
cttcctttcatccggcacggctgtgtccccacatctccctaaagctccgggtattttaagttatacaagggaaatatacgggctggactacaacttgcaggttgcacagcgttatggataggcggataaagggcccaagcaagatcgtgaagcttggacgcgtctggttggacaatggtgactttttgtgtattagataatgcttgactggagaatatcaggactgagcagagttaggaagaccacaaaaaaggtatataagggcaacaaagtctccgtgatatggataggctcttctctctggttacaattcattatttcagttgtttgctagatatagagatataatacatctaataaacagtcacttccagagatatatatatatacatatatctatctcctcctcccagcttaaataataactatatttgtttaactcgaagaaaaaaaaaattcaaatttactctatcaattcaattacctcataaaaaacaata

SEQ ID NO: 43 - DNA, 500 bp, Saccharomyces bayanus; identical to SEQ ID NO: 42

SEQ ID NO: 44 - DNA, 500 bp, Saccharomyces paradoxus
cgataccacacggtccattgggccggtggtgttagtcgacggatatatgcatctgtcccctttcccggcgagccggcagtcgggccgaggttcggataaatttttgcattgtattagtttctgtcatgagtattacttatggttcctttagagctaatcattagctcggtaccggctgttatgcaatttatgacttttcttctacagtgtcagccttgtgacgattatctatgaactttggatgtagcgcatcgagattcgtatctttcattggatagtaaatgggaaggatcgatgacccttattacattctttcctatacttaatatccatttaatctatcttcttgaaagtatataagtaacggtaaatttaccatacttatgctattctcatttatcccctaattttcttttaacttctcgccctacagtaactaagaataacggctactgtttcgaaattaagcaaagtagtaaagcacataaaagaataaagaa

SEQ ID NO: 45 - DNA, 500 bp, Saccharomyces kudriavzevii
agaccgaagcgggtaatggacggaattaagcaattgtcccctctcccggggagccgacagtcggaccgagcttcggataaatttctgtattgtttttgtttccgtcatgggtattattttcgggatccttttgccaaccccatagtcaatcgttaacatttaccggccaatatgtaggattatgactattctcctgcatgatcagcggaagtgacgattatctattaattttgaacttctacttcgtgatccggaatttaattggataataatgtgtccgaaggatcgagtgacccttatattctgtagttttttgttactggccatccaattcgtgttcttggaagtatataagttacagtcgattgacctttctcaagctattttcatctttctcctacatttacgtttctcttcttcaatacagcagctagaagttacgattactcctgtgaagataaacaaagtaatagtagcccacaaaaagagagaaagtaaaa

SEQ ID NO: 46 - DNA, 500 bp, Saccharomyces bayanus
gtagcagtccggaaataagcaaatgtcccctttcccgagctaaccaacggtcgggccgagcctcggataaatttttgctttgtttttgtttctgtcatgggtattatacatcatttatttagttaacccctagactaattagccggccattagtatgtaagattatgactatagtttgtaccggaaccctggtagcaactactcatgaactttgggctcagtatttcgcaatcccggttttaattggatagcctatcgcgaaggatcgatggatgacccttagaattgtctcttttgttactactcattcaatgcgtgtgctcttgcaagtatataagtcactctaaattagtttatacttgagctttttacatttctcccttgattgtttctttctcttttccccttgttctggtttattgtaatagctaagtgcaacgattaccgctgttaagttaaagaagagagacaagtaataatagtacacagcaaggaaaaaa

SEQ ID NO: 47 - DNA, 500 bp, Saccharomyces paradoxus
ttactaaataggctggcatcagctaacccggatggttgaatccggcttttgctacttgttgtccgatgaaaaggagcggcttcccttttgccccagatttccattcatccgagaggtcgcttatcagacttcgtcatttctcatttcatccgagatgatcaaaattgaagccaatcaccacaaaactaacacttaacgtcatgttacactaccctttacagaagaaaatatccatagtccggactaacattccagtatgtgactcaatattggtgcaaatgagaaaatcatagcagtcagcccaagtccgccctttaccagggcaccgtaattcacgaaacgtttctttattatataaaggagctactttactagcaaaattcttgtaattcctcttcccttgctaacttcttcttgttttcttttcctttttacacacagatatataacaattgagagaaaaactctagtataacataacaaaaaagtcaacgaaaaaa

SEQ ID NO: 48 - DNA, 500 bp, Saccharomyces kudriavzevii
gttacggtgccgcgccggtggccggtggtcttccggtaaacaaaaaaagctgcctccctttcgccccagatttccattcatccgagggcaccgcttgtcagactttatcgttttcctcatttcatccgagaagatcaattcaaaggcaatgaccacaaaagcaactcctaacgttgtgttacgctaccctttacacaaaatattcataacccgtaatgaatcctaaggtatgtgactcaattttggtgtagaaaatgaggaaaacgtaatactaagttaaagctcgccctttaaagtgaatattccttgaccatttgcgcaggcacacccgaattcacaaacgtttctttattatataaaggaccagctctgctagtcaaatttttataactgcttgttcagttgctgcttctttcttgtcaatttatttcttgtactgttcaactacataaagcaaagagaaaactctcagaataacataacaaagaagtcaacgaaaa

SEQ ID NO: 49 - DNA, 500 bp, Saccharomyces bayanus
acgaggctcggcgtttactgctgaatttccggaaagaaagggaaggttccctttaccccagatttccattcatccgaaggactgcttatcagaatttgacatttttctcattttatccgagaagatcaatttaaggctagtgaccacaaaactaactctcatgctgcgctaccgcaagtttcgctcacagaaagaaagcaagcacccatagtccggactacatccttgtatgtgactcaaatttttggcgttgccaattaaactgaagtgtaaagattacttcaagctcaccctttaaagtagaattccttaacggttttaaatagacacaccgaaattaataaacactttctttattatataaaggacagagtttattactggaattctcttaacgccttcctcccttactattgtatcttttcctttcacataatcgctacataactacatagagaaaactctcagattaacacagtaacaacgaagaaaacaaaaaa

SEQ ID NO: 50 - DNA, 500 bp, Saccharomyces cerevisiae
acagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaa

SEQ ID NO: 51 - DNA, 412 bp, Saccharomyces cerevisiae
atagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 52 - DNA, 500 bp, Saccharomyces cerevisiae
tgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaa

SEQ ID NO: 53 - DNA, 800 bp, Saccharomyces cerevisiae
catgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 54 - DNA, 430 bp, Saccharomyces cerevisiae
tatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaa

SEQ ID NO: 55 - DNA, 466 bp, Saccharomyces cerevisiae
gcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcgcatgccagcattgaaatgatcgaagttcaatgatgaaacggtaattcttctgtcatttactcatctcatctcatcaagttatataattctatacggatgtaatttttcacttttcgtcttgacgtccaccctataatttcaattattgaaccctcac

SEQ ID NO: 56 - DNA, 382 bp, Saccharomyces cerevisiae
acaaatcgctcttaaatatatacctaaagaacattaaagctatattataagcaaagatacgtaaattttgcttatattattatacacatatcatatttctatatttttaagatttggttatataatgtacgtaatgcaaaggaaataaattttatacattattgaacagcgtccaagtaactacattatgtgcactaatagtttagcgtcgtgaagactttattgtgtcgcgaaaagtaaaaattttaaaaattagagcaccttgaacttgcgaaaaaggttctcatcaactgtttaaaaggaggatatcaggtcctatttctgacaaacaatatacaaatttagtttcaaagatgaatcagtgcgcgaaggacataactca

SEQ ID NO: 57 - DNA, 400 bp, Saccharomyces cerevisiae
agtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacct

SEQ ID NO: 58 - DNA, 500 bp, Saccharomyces cerevisiae
ggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgacagtccaaatgttgatttatcccagtccgattcatcagggttgtgaagcattttgtcaatggtcgaaatcacatcagtaatagtgcctcttacttgcctcatagaatttctttctcttaacgtcaccgtttggtcttttatagtttcgaaatctatggtgataccaaatggtgttcccaattcatcgttacgggcgtattttttaccaattgaagtattggaatcgtcaattttaaagtatatctctcttttacgtaaagcctgcgagatcctcttaagtatagcggggaagccatcgttattcgatattgtcgtaacaaatactttgatcggcgctat

SEQ ID NO: 59 - DNA, 1041 bp, Aspergillus tubingensis
atgctgggattcccaatgttcaacccagctacgcctgatgtctggaagatgaataccccttactttccatttgttacaccggggttatttcctgcctcagcacccccatcgcccaccaacgtagatgccgaagctgccagttcccaacagtcggaagcaagctatctggataaggagaaaattgttcgagggccacttgattatcttctcaaatcccctggaaaagacattcgtcggaaattcattcacgcgttcaatgaatggctgcgcattcctgaggacaagttgaatattatcacggaaattgttggattgcttcacacggcctcccttctaatcgacgatattcaggacaattccaagcttcgacgcggcctcccagtggcccatagcatatttggtattgcgcagacaattaactctgccaattatgcgtactttctagcccaggaaaggctccgcgaactgaatcatcctgaagcgtacgaaatatacacagaggaactgcttcgtctgcaccgcggtcaaggtatggacttgtactggcgggactgcctaacctgtcccacagaggaggactatattgagatgatcgccaacaagactggtggcctatttcgactggcgattaagcttatgcagttggaaagcactttgtgcagcaatgtcattgaactagcagacttgttgggcgtgatctttcagattcgggatgattaccaaaacttacagagtggactatacgccaagaacaagggattttgcgaggatttgacggagggaaaattttcctttctgattatccacagtattaacagtaacccgaacaatcaccatctgctaaatatactacggcagcggagcgaggacgattcggtgaagaagtatgctgttgattatatcgactcgacggggagttttgactactgccgggaacggctcgcttccttattggaagaggcggatcaaatggttaagaagttggaaaatgaggggggacaatcaaaggggatctacgatattctgagctttctgtcgtga

SEQ ID NO: 60 - DNA, 732 bp, Aspergillus tubingensis
atggatgggttcgaccattctactgctccaccaggatataacgagctaaaatggctcgccgatatcttcgtcatcggaatggctgttggctgggttgctcactatatggagatgattcacacgtcgttcaaggaccaaacatactgcatgaccatcgggggcctttgcatcaattttgcctgggaaatcatattctgcacaatgtatcctgccaaaggatttgtcgagcgggttgcctttctcatgggcatttctctcgaccttggggttatttacgcgggaatcaagaacgccccaaatgaatggcaccactctgcaatggtgagggaccatatgccccttgtcttcgcagcaacgacactttgttgtctgagcggtcatatggctcttactgcccaggttggtcccgcacaagcctatacgtggggggcaattgcatgccagctctttatcagcatagggaatgtgtttcaattgttgagtcggggaaacacacgaggggcgtcatggacgctatggacctccaggttttttggatcaacatcagccattggctttgctcttgttcgatatattcgctggtgggaggccttttcttggttgaactgcccgcttgtgatatggtccgtggccatgttctttctgtttgaaacactctatggagccctattctattctgtcaagcgacaagaagggagatcccagcgtggaatcaagcacaaagagaggtag

SEQ ID NO: 61 - DNA, 1008 bp, Aspergillus tubingensis
atggcggcacttccggacgttgcctccattcccatccctctggtggcaaccctaggcattgcccctctaattttctatctcgtccttgatagaattagccccttgtggccaaattccaaagctttcctgattggcaagaagaaaccggagaccgtgacatcgttcgagtgcccatatgcctacatccgtcagatctatgggaagtatcactgggagccattcgtacagaagctgtctccgaggcttaaggatgaggatccggccaaatataagatggttctggagataatggatgcaatccacctgtgtctgatgctagttgacgatataactgacaatagcgactatcgaaaaggcaagccagcagcccaccggatatatggcccttcagagacagcaaatcgcgcttactaccgagtcacccagattctaaacaagaccgtgcaaaagttccccaagctggccaagttcctgcttcagaatctggaagaaattctcgaaggccaagacctgtcactaatctggcgacgggatggactgggtagcctttcgactgttcctgatgagcgagttgcagcctatcgcaagatggcgtcattgaaaactggggcgttattccggctgctggggcaattggtgatggaggaccaatcgatggacgggacgatgactactcttgcgtggtgctctcagctgcagaatgactgcaagaatgtctactcatctgaatatgctaaggccaaaggggcgcttgccgaagacctccgaaatcgagagctctcatttccaattatcctcgcgctggaagctcctgaagggcattgggtcgccagtgctttggagaccagctcaccgcgcaacattcgcaaggcgcttgctgtgattcagagtgagagagtgcgcaatgcttgtttcaaggagctcaagtcggcgagtgcttcggtccaggactggttggctatttggggacggaacgagaaaatgaacttgaagagccagcagacgtag

SEQ ID NO: 62 - DNA, 1416 bp, Aspergillus tubingensis
atggccaatgcccagcaacccccctttcgcatccttattgtgggcggttctgtcgcaggcctcatccttgcgcactgtctcgaacgcgccaatatagagtacctcatactcgaaaaaggagaagatgttgctccacaagttggtgcctcgataggtatcatgccaaatggcggacggatcctcgagcaactgggcctatttggggagattgagcgtgtgatcgagccgttgcatcaggcgaatatcagctatccagatgggttctgctttagtaacgtctatcctaaggttcttggcgacaggttcggatacccggttgcattcttggaccggcagaagttcctgcagattgcatatgaggggctgagaaagaagcagaatgttctcaccggtaaaagggtagttggactgcgacagtcggatcaagggactgctgtttctgtggctgacgggacagagtatgaggcggatctcgtggttggtgctgatggagtacatagtcgggtgagaagtgagatttggaagatggcggaagagaatcagcctgcatcagtttcgacacgtgaaagaagaagcatgactgttgaatatgtctgcgttttcgggatttcatcagccatcccagggctcgagataagcgaacagatcaacggtattttcgaccatctatccattctaacaatccatggcagacatggtcgcgtgttctggttcgtgatccagaagctggataggaagtacgtctatcctgatgtcccgcgattctcagacgaggatgccgtacagctcttcgatcgggtcaaacacgtgcggttctggaaaaacatctgtgtgggggacttgtggaagaacagagaggtgtcctcgatgacagcgctggaggagggagtgttcgagacatggcatcatgataggatggttttgattggagatagcgttcacaagatgacgcccaactttggccaaggagctaattcagccatcgaggatgctgccgcgctctcttcccttctacatgatctcgtcaacgcccgtggagtttgcaagccatcgaatgtccagattcagcatctcctcaagcagtatcgggagacccgatacactcgcatggtaggcatgtgtcgcaccgcggcttcagtctctcggattcaggcccgagatggcatcctcaacaccgtctttggacgatattgggcaccttatgctggcaacctgcctgctgacctggcatcaaaagtgatggcagatgcagaggttgttacttttctgcccttgccagggcgctcaggaccgggctgggagatgtacagacgaaaggggaagggagggcaggtgcaatgggtgcttataatcttaagcttacttacgattggtggattgtgcatctggctacaaagcaatgcgttgagtagataa

SEQ ID NO: 63 - DNA, 7050 bp, Hypomyces subiculosus
atgccttctaccagcaatccatctcacgtccctgtggccatcatcggcctggcatgccgattcccaggcgaggccacctcaccatcaaaattctgggatcttcttaagaatggacgagatgcctactcaccaaataccgatcgatataacgctgatgccttttaccatcccaaggcaagcaaccgccaaaacgtgctggcaactaagggcggccacttcctcaaacaggacccatacgtttttgacgccgctttctttaacatcacagccgctgaggccatctcctttgaccccaagcagcgaattgccatggaagttgtctacgaggctctagaaaatgccggaaagacactacccaaggtggcgggcacacaaactgcttgctatatcggctcttccatgagtgattaccgagacgctgttgtgcgtgactttggaaacagccccaagtatcatatcctgggaacatgcgaggagatgatttcaaatcgtgtgtcccatttcttggatattcacggccccagtgccaccattcatacagcctgctcatcaagtcttgttgctacacacttggcttgccaaagtttgcaatctggagagtcagaaatggccatcgctggtggtgttggtatgatcatcacccctgatggtaatatgcatcttaacaacttgggattcttgaaccccgagggccactcccggtcatttgatgagaatgctggtggttacggtcgtggtgagggttgcggtatcctcatcctcaagcggctagacagagctctcgaagatggtgattccattcgcgccgtcattcgagcctctggtgtcaactctgatggctggacacagggtgtcaccatgccctccagccaagcccagtctgcccttatcaaatacgtatacgaatcgcatggcctggattatggtgcgactcaatacgttgaggctcacggtactggtaccaaagccggtgatcccgcagagattggcgccctccaccgcacaattggacagggcgcgtccaagtctcgaaggctttggattggcagtgtcaagccaaacattggccatcttgaagccgccgccggtgtggctggtatcattaagggcgtcctgtccatggaacacggcatgattcctccaaacatttacttctccaagcccaaccctgccatccctcttgacgagtggaacatggccgtgcctaccaagttgactccctggcccgccagccaaactggtcgccgtatgagtgtcagcggtttcggtatgggtggtaccaacggccacgtcgtccttgaggcctacaagccccaaggaaagctcaccaacggccataccaacggcatcaccaatggaatccacaagactcgccacagcggcaagaggcttttcgtcctcagcgcccaggatcaagctggcttcaagcgtttgggtaacgccctggtggagcatctcgatgccctgggccctgccgctgccacccctgagttcctcgccaacctctcccacactcttgccgttggcagatctggcttggcttggaggtccagcatcatcgctgagagcgcccctgatcttcgggagaagctggcaactgatccgggtgagggagccgctcgttcttcaggcagcgagccccgtattggattcgtcttcacgggtcaaggtgctcagtgggcccgcatgggcgttgagttgttggagcgccccgtcttcaaggcttccgtgattaagtccgcggagactttgaaggagctcggctgtgaatgggaccctatcgttgagctttccaagcctcaagctgagtctcgacttggtgttcctgaaatctcacagcccatctgcacagtcctacaagtcgccttggttgatgagttgaagcactggggtgtatcaccttccaaggtggtcggtcactccagtggtgaaatcggtgccgcatacagcattggcgctctttctcaccgtgacgctgtcgccgctgcttacttcaggggcaagtcttccaacggagccaagaagcttggtggtggtatgatggctgttgggtgctctcgtgaggacgctgacaagctcctctctgagaccaagctcaagggcggtgttgctaccgtcgcatgtgtcaactccccctccagcgtgaccatctcaggcgatgccactgctctcgaggaactccgagttattctcgaggagaagagtgtgtttgctcgaagactcaaggtcgacgttgcctaccactctgcccacatgaacgctgtctttgccgaatactctgctgcgattgcccacattgagcccgctcaggcagttgaaggtggaccgattatggtctccagtgtcactggtagcgaagtcgactctgagcttctcggcccttactactggacccgtaacttgatctctcccgtcttattcgccgacgctgtcaaggaattggttacccctgctgatggcgacggccaaaacaccgtcgatctcctgattgagattggtcctcacagcgctcttggtggccctgttgagcagattctgtcccataacggcatcaagaatgttgcttacagatctgctcttactcgtggcgagaacgctgttgactgcagcctcaagcttgctggcgagctcttccttctcggcgtgccctttgagttgcaaaaggccaacggtgactctggttctcgcatgctcactaacctacctccttatccttggaaccactccaagtcattccgtgccgactctcgtctccaccgtgagcatctggagcagaaattccctactaggagtctcatcggtgcacctgtccccatgatggcagagagcgagtacacatggcgcaacttcatccgtctcgctgacgagccttggctccgtggtcacactgtcggtaccaccgttctgtttcctggtgccggtatcgtgagcatcatcttggaagctgctcaacagctggtggataccggcaagaccgttcggggcttccgaatgcgcgatgtcaacctcttcgccgccatggctctccccgaggacctggctactgaggttatcatccacatccgacctcaccttatctctactgttggatcaaccgcccccggtggatggtgggagtggactgtttcctcctgcgtcggaactgaccagctgcgagacaatgctcgcggtctggtagccattgactacgaagagagccgcagcgagcagatcaacgccgaggacaaagcgttggttgcttctcaggtcgcggactaccacaagatcctcagcgaatgccctgagcattatgctcatgacaagttctaccagcacatgaccaaggcctcttggagctacggcgagctcttccagggtgtggagaatgtccgtcctggatacggaaagaccatctttgacatcagagtcattgacattggtgagacctttagcaagggacaacttgagcgacctttcctcatcaacgctgccactctcgatgctgtattccagagctggctcggcagtacctacaacaacggtgctttcgagtttgacaagcccttcgttcccacctctattggcgagttggaaatctctgtcaacattcccggtgatggcgactacctcatgccaggccactgccgctctgagcgatacggcttcaacgagttgtctgctgatattgccatcttcgacaaggatctgaagaatgtgttcctttcagtgaaggatttccgaacttccgagcttgatatggattccggcaagggagacggagatgccgctcacgtcgaccctgccgatatcaactcggaggttaagtggaactacgctcttggcctcctcaagtccgaggaaatcaccgagctggtcaccaaggtcgccagcaatgacaagctcgccgagcttctccgtctgacacttcacaacaaccctgctgccactgtcatcgagcttgtttctgatgagagcaagatctctggcgcatcttctgccaagctgtccaagggccttatcctccccagccagatccgttacgtagttgtcaaccctgaggcagcggacgccgactctttcttcaaattcttctcccttggtgaggatggtgcccctgtcgctgctgaaaggggccccgccgaactgttgatcgcctccagcgaagtcactgacgcggctgtccttgagcgcctgattaccttggccaagcctgatgccagcattcttgttgctgtcaacaacaagactaccgccgctgccctctcagccaaggcgttccgtgttgtcaccagcatccaggacagcaagtccattgctctctacactagcaagaaggcgcctgccgccgacacctccaagctcgaggccatcatcctcaagccaaccactgctcaacctgccgcccagaatttcgcctccatcctccagaaggcactcgagctccagggctactctgtcgtttctcagccatggggcaccgacatcgacgtcaacgatgccaagggaaagacctacatttctctgttggagcttgagcagcctctgctcgacaacctctccaagtccgacttcgagaacctccgcgcagtcgttttgaactgcgagcgtctcctgtgggtcacagcaggtgacaacccatctttcggcatggttgatggtttcgctcgctgcatcatgagcgaaattgccagcaccaagttccaggtcctgcatttgagcgctgcaactggtctgaagtacggatcttctctcgccacccgcattctccagtcggatagcaccgacaacgagtaccgggaggtcgatggtgctctccaggtggcccgtatcttcaagagctacaacgagaacgagagtctccgccaccacctcgaggataccaccagcgttgtgactcttgctgaccaggaggatgctctgcgcctcactattggcaagcctggtcttttggatactttgaagtttgtccccgatgagcgtatgctcccacctctccaggatcacgaggttgaaatccaggtcaaggctactggtctgaacttccgagacatcatggcttgcatgggtcttattcctgttcgatctctgggccaggaggccagtggcatcgtcctcagaaccggtgcgaaggctaccaacttcaagcctggcgaccgtgtttgcaccatgaacgtcggaacacatgccaccaagatccgagccgactaccgtgtcatgacaaagatccccgactccatgacctttgaagaagctgcctcggttgctgttgttcacaccaccgcctactacgccttcatcaccatcgccaagcttcgcaagggccagtccgtcttgatccacgccgccgctggtggtgttggccaagcagccattcagttggccaagcatctcggcctcatcacctatgttaccgtaggtactgaagacaagcgccagctcattcgggagcagtatggcattcccgacgagcacatcttcaactcccgtgatgccagcttcgtcaagggtgtccagcgtgttaccaacggtcgcggtgtcgactgcgttctcaactctctatccggtgagctcctgcgtgcttcttggggatgccttgctacctttggtcatttcatcgaaattggtctccgtgatatcaccaacaacatgcgtcttgacatgcgacctttccgcaagagcacctccttcacattcatcaacacccacactctcttcgaggaagaccccgctgcgttgggagatattctcaacgagtccttcaagctcatgttcgctggcgcccttaccgctcctagccccttgaatgcctatcccattggccaggtcgaggaggccttccgaaccatgcagcagggcaagcaccgcggtaagatggtgctgtccttctccgatgacgcaaaggctcccgtgttgcgcaaagcgaaggattccttgaaactggaccctgacgccacttacctctttgttggtggtcttggtggtctgggtcgcagtcttgccaaggagtttgttgcgtctggcgcccgcaacattgccttcttatcccgatccggtgacactaccgcccaggccaaggctatcgtggacgaattggctggccagggtatccaggtcaaggcctatcgtggtgatatcgccagcgaggcatccttcctccaggctatggagcaatgctctcaggatctcccgcccgtaaagggtgtgatccagatggccatggttctccgcgatatcgtctttgagaagatgtcgtacgatgagtggaccgtccccgttggccccaaggtccaaggttcatggaacttgcacaagtacttcagtcatgagcgacctcttgacttcatggtcatctgctcctcaagctccggtatctacggttatcccagtcaggctcaatacgccgctggcaacacttaccaggatgccttggctcactaccgtcgctctcagggcctgaacgccatctccgtcaacttgggtatcatgcgagatgtcggtgtcctggctgagacgggtaccactggtaacatcaagctctgggaagaggtcttgggcatccgcgagcctgccttccacgctctcatgaagagcttgatcaaccatcagcagcgtgggtctggggactacccggcgcaggtctgcactggtcttggtactgctgacattatggctactcacggcctggcccggcccgagtatttcaatgacccccgttttggaccccttgccgtcaccactgtcgcgaccgatgcttcagctgacggccagggctctgctgtctcgctcgcctctaggctctccaaggtttccaccaaggatgaagctgccgagatcattaccgatgctctggtcaacaagacggcagacatcctgcagatgcccccctctgaagtcgaccccggccgacctctgtaccgttatggtgttgactcccttgtggcgcttgaggtgcgaaactggatcacaagggagatgaaggcgaacatggcgctgctggagattctggcagccgtccccattgagagcttcgctgtcaagattgctgagaagagcaagttggttactgtttaa

SEQ ID NO: 64 - DNA, 6150 bp, Hypomyces subiculosus
atggtgactgtaccacagactatcctctactttggagatcagacagactcctgggttgattccctcgatcagctatacagacaagccgctacgataccatggctacagacgtttctcgacgaccttgtaaaggtcttcaaggaagagtcccggggcatggatcatgcgttacaagacagtgttggtgaatactctacactactcgacttggcggatagataccgccatggcaccgacgagattggtatggtgcgtgctgtcttgctacatgccgcgagaggaggcatgctattacaatgggtgaagaaagaatcacagcttgtggacctcaatggctccaagcctgaagcactcggtatctctggaggactcaccaacctcgcagcactggcgatatccacagacttcgagtctctatatgacgcagtcattgaggctgcgagaatatttgtcagattatgccgttttacttcggtacgatcaagagctatggaggaccgacctggcgtttggggctgggcagtgctgggaattacaccagaggaactgagcaaagtgcttgagcagttccaatccagcatggggattcctgccatcaagagagctaaggttggcgtaacaggagaccgatggagcaccgttattgggccaccctcagtcttggacctattcatccaccagtgtcccgctgtgcgcaacctccccaagaatgaattgagcatccacgcccttcagcacacagtcacagtcacagaggctgacctcgacttcattgtcgggagtgctgagcttcttagtcaccccattgtgccagacttcaaagtctggggaatggatgatcctgtggcatcctaccagaactggggagaaatgctaagagcaatcgtcactcaagttttgtccaagcctttggacattaccaaggtgattgcgcaactcaacactcacctcggccctcgtcatgtcgacgtccgagtcatcggacctagcagccacaccccctacttggcgagttcgctcaaagctgctggcagcaaggctattttccagaccgataagactcttgagcagttacagccgaagaaactccccccgggccgcatcgccattgtcggtatggctggccgtggtcctggctgcgagaatgttgatgagttctgggacgtcattatggcgaagcaggatcgttgtgaagagattcccaaagatcgcttcgacatcaatgagttctactgtaccgagcacggggagggttgcaccaccaccacaaaatacggctgcttcatgaacaagcctggaaactttgactcccgcttcttccacgtgtcgcctcgtgaggcgctgttgatggaccccggtcacaggcagttcatgatgagcacttatgaagctcttgagacggcaggatactctgatggccagactagggacgttgatcctaataggatcgcggcgttctatggccagtccaacgatgattggcatatggtgagccattataccctgggttgtgatgcctacaccctgcagggggcgcaaagagccttcggcgctggtcgcatcgccttccacttcaagtgggagggcccaacatactcgctcgattctgcatgtgcctccacctcctctgctattcacctggcctgcgtgagtcttctatccaaagatgtggacatggctgttgtgggtgctgccaacgtcgtcgggtatcctcactcctggacaagtcttagcaagtctggtgtcttgtccgacactggaaactgcaaaacctactgcgatgatgctgatggttactgccgagcagactttgtcggctcagttgtgctgaagcgtctcgaagatgctgtcgagcaaaacgacaacatcttggctgtcgtggctggttcaggcagaaaccactccggcaactcttcatccatcaccacgtcggatgccggtgcccaggagagactgtttcacaagattatgcacagcgccagagtctctcctgatgagatctcatatgttgagatgcacggcactggaactcagattggcgatccggccgagatgagtgctgttaccaatgtcttcaggaagaggaaggcgaataaccccctaactgttggtggaatcaaagcgaacgtcgggcatgctgaagcttctgctggcatggcctccctgctcaaatgcatacagatgttccagaaagatattatgccccctcaggctcgaatgccccatactctcaacccaaagtatccgagtctttctgagcttaacattcatatcccctccgagccgaaggagttcaaggctatcggcgagcggccacgacgcatcctccttaataactttgacgcagcaggtggcaacgcctctctcattctggaagacttcccctccaccgtcaaggaaaatgcggaccccaggccaagccatgtcatcgtttcctctgccaaaacacaatcctcatatcacgcgaataagcgtaacctcctgaagtggctacgcaagaacaaagatgctaaactcgaagatgttgcatacacaaccaccgcccgcagaatgcaccaccccctcagattctcttgcagtgcctccacaacggaggagctcatttccaagcttgaggcagacacggcagatgcaactgcgtctcggggctcgcccgttgtcttcgtattcacgggacagggctctcactacgccggcatgggtgccgagttgtacaagacatgccctgctttccgcgaggaagtcaacctctgtgccagcatctctgaggagcacgggttccccccgtacgtggatatcatcaccaacaaagatgttgacataaccaccaaggacaccatgcagacacagctcgctgttgtcacgctggagatcgccctcgccgcattctggaaggcgtctggtatccagccgtcagcagtcatgggtcactccctgggcgagtatgtggctctccaggtcgcaggggtcctatctctagctgatctgctctacctcgtcggcaatcgggcccgtctcctgctggagcgctgcgaagccgacacctgcgctatgttggcagtatcaagctctgctgcctccatccgcgagctcatcgaccagcgcccgcagtcatccttcgagattgcatgcaagaatagccccaatgccacggttatcagcggcagcactgatgagatttctgagctccagtcatccttcacggcatcacgagccagggctctgtctgtgccctatggatttcactccttccagatggatcccatgctcgaggattacatcgttcttgcgggtggtgtaacctactcgccaccaaagattccagttgcttcaaccctgctcgcttcgattgtggagtcttcaggggtcttcaacgcttcctacctcggtcagcaaacccgccaagctgtcgacttcgtcggtgctcttggcgccttgaaggagaagtttgctgaccctctctggctggagatcggacccagccaaatctgcagctcctttgtccgggcgactctctcaccctcgccgggcaaaatcttgtccactttggaggcaaataccaacccctgggcatccatttccaagtgcctcgccggcgcgtacaaggatggtgtcgcagttgactggttggcggtgcatgctccattcaagggcggcttgaagctcgtgaagttgcccgcctatgcatgggacctcaaggacttctggattgtctactctgaggccaacaaggctgctcgagctttggctcccgctccctcgttcgaaacacagaggatttctacatgtgctcaacagattgttgaagaatcatcatcacccagcctccatgtctctgcccgagctgctatctccgatcctggcttcatggccttggtcgacggtcatcgcatgcgcgatgtgtccatctgccccggaagtgtcttctgcgaggcaggccttgccgtctccaagtacgcactgaagtacagtggccgaaaggataccgtggaaacaagacttacaatcaacaacctgtctctcaagcgcccgctcacaaagtctcttgtaggcaccgatggcgagcttctcaccacggttgttgcagacaaggcctccagcgataccttgcaggtttcatggaaggcttcttcctctcatgcatcatacgatcttggtagctgcgagatcaccatttgtgatgcccagactcttcaaactagctggaacagaagctcatacttcgtcaaggctcgtatgaacgagttgatcaagaatgtcaagagcggaaatggtcaccgcatgctccccagtatcctctacactctcttcgctagcacagttgattatgaccctaccttcaagtctgtcaaggaggccttcatctcaaatgagtttgacgaagctgctgcggaggtggtgcttcagaagaacccggctggaactcagttctttgcgtccccttactggggtgagagcgtagttcatcttgccggtttcctcgtgaactccaaccctgcccgcaagactgcttctcagacgaccttcatgatgcagagtcttgagagcgtcgagcagaccgctgatctcgaggctggacgcacttactacacctatgctcgcgttttgcatgaggaagaagacacagtcagctgtgacttgttcgtcttcgactcggagaagatggtaatgcagtgctcgggactctcattccatgaggtcagcaacaatgttctggacagacttcttggaaaggcatcaccgcctgtgaagcaagtttcccaccagaaggcgccagtgcttgtgcccgcagagtcaaaaccggccctgaaagctgctgtcgaggcggctcccaaggcgcctgagcctgtgaagacagaggtgaagaagatctcttcgtcggagagcgaattgttccacactattcttgaaagcatcgccaaggagactggcactcaggtctctgacttcactgatgacatggaactggctgaacttggcgttgattccatcatgggtattgagatcgctgccggcgtcagcagcagaaccggcctcgatgttctcctcccctcttttgtcgtagattatcccaccattggagatctgcgaaacgaatttgcgcgctcctctacatctacacctcccagcaagaccttttccgagttctccatcgtcgatgccactccagagtctacgcgcagctcgagtcgagcgccttctgagaagaaggagcctgctccggcttcagagaagtctgaggagctggtgatcgttccgtccgcggttgtcgaggattcctctcccctccccagtgccagaatcaccttgatccagggtcgatcttcgagtggaaagcagcctttctacttgatcgccgatggagctggtagcattgctacgtatatccacctggctcccttcaaggacaagagaccggtttatggcattgattcgcctttcctccgttgccccagcaggctgaccacccaggtgggcattgaaggcgtcgcaaagatcatctttgaggcgttgattaagtgccagcctgagggtccctttgacttgggaggattctctggcggagctatgctcagctatgaggtgtctcgccaactcgctgccgccggtcgcgtcgtctccagtcttctcctcatcgatatgtgttctccccgtcctttgggtgttgaggacacaatcgaggtcggctggaaggtctacgagaccatcgcttcccaagataagctctggaacgcctcaagtaacacccagcagcatctcaaggccgtcttcgcctgcgtcgcagcctaccaccctcctcccatgactcccgctcaacgacccaagcgaacagctatcatctgggctaaaaagggcatggtcgaccgttgttctcgcgacgagaaggtgatgaagttcctggccgacaagggcatccccaccgagtcgtacccagggttcatggaggaccccaagctgggtgccgtggcgtggggccttccgcacaagtccgctgcggacttgggacccaacggatgggacaagttccttggcgagactctgtgcctgtctatcgattcggaccacttggatatgccgatgccggggcatgtgcacttgcttcaggcggcgatggaggagtcgttcaaatatttcagcgaggcaaattag

SEQ ID NO: 65 - DNA, 14802 bp, Artificial Sequence
  Description of Artificial Sequence: Synthetic polynucleotide
tatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaaaggcagaggagagcatagaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacacaatgctgggattcccaatgttcaacccagctacgcctgatgtctggaagatgaataccccttactttccatttgttacaccggggttatttcctgcctcagcacccccatcgcccaccaacgtagatgccgaagctgccagttcccaacagtcggaagcaagctatctggataaggagaaaattgttcgagggccacttgattatcttctcaaatcccctggaaaagacattcgtcggaaattcattcacgcgttcaatgaatggctgcgcattcctgaggacaagttgaatattatcacggaaattgttggattgcttcacacggcctcccttctaatcgacgatattcaggacaattccaagcttcgacgcggcctcccagtggcccatagcatatttggtattgcgcagacaattaactctgccaattatgcgtactttctagcccaggaaaggctccgcgaactgaatcatcctgaagcgtacgaaatatacacagaggaactgcttcgtctgcaccgcggtcaaggtatggacttgtactggcgggactgcctaacctgtcccacagaggaggactatattgagatgatcgccaacaagactggtggcctatttcgactggcgattaagcttatgcagttggaaagcactttgtgcagcaatgtcattgaactagcagacttgttgggcgtgatctttcagattcgggatgattaccaaaacttacagagtggactatacgccaagaacaagggattttgcgaggatttgacggagggaaaattttcctttctgattatccacagtattaacagtaacccgaacaatcaccatctgctaaatatactacggcagcggagcgaggacgattcggtgaagaagtatgctgttgattatatcgactcgacggggagttttgactactgccgggaacggctcgcttccttattggaagaggcggatcaaatggttaagaagttggaaaatgaggggggacaatcaaaggggatctacgatattctgagctttctgtcgtgagcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcgcatgccagcattgaaatgatcgaagttcaatgatgaaacggtaattcttctgtcatttactcatctcatctcatcaagttatataattctatacggatgtaatttttcacttttcgtcttgacgtccaccctataatttcaattattgaaccctcacgatccagttctccagtgacacagcctttatctggtcaaacctttctttctaatcacctatgctgatgcttaattaagggatttttgtctccatcaacggcatgcgcccaaaaatgacgttttttttaacccatagacacgaaactacccattttccaccggcctgacctaccaccggaacaacggccatctccaacttgcaagttggggaaattaagagcatcgcaggtttaatggaagaaaaaaaaaaggtacagcacagcgcaaatggagttagttcccttatgtcacacactcacacacagtcggtcagatcaagcatactgggtgcgtataaatagagtggccattgccaccctgtttatctcaaaatctgtcttgttagtggtcttctccctttttcaggttacaattctcttgtttctacttagtatataagtatatcaagctatattaagcatactatcaactgtcaactctatcctcaaaatacaatacaaaatggatgggttcgaccattctactgctccaccaggatataacgagctaaaatggctcgccgatatcttcgtcatcggaatggctgttggctgggttgctcactatatggagatgattcacacgtcgttcaaggaccaaacatactgcatgaccatcgggggcctttgcatcaattttgcctgggaaatcatattctgcacaatgtatcctgccaaaggatttgtcgagcgggttgcctttctcatgggcatttctctcgaccttggggttatttacgcgggaatcaagaacgccccaaatgaatggcaccactctgcaatggtgagggaccatatgccccttgtcttcgcagcaacgacactttgttgtctgagcggtcatatggctcttactgcccaggttggtcccgcacaagcctatacgtggggggcaattgcatgccagctctttatcagcatagggaatgtgtttcaattgttgagtcggggaaacacacgaggggcgtcatggacgctatggacctccaggttttttggatcaacatcagccattggctttgctcttgttcgatatattcgctggtgggaggccttttcttggttgaactgcccgcttgtgatatggtccgtggccatgttctttctgtttgaaacactctatggagccctattctattctgtcaagcgacaagaagggagatcccagcgtggaatcaagcacaaagagaggtagacaaatcgctcttaaatatatacctaaagaacattaaagctatattataagcaaagatacgtaaattttgcttatattattatacacatatcatatttctatatttttaagatttggttatataatgtacgtaatgcaaaggaaataaattttatacattattgaacagcgtccaagtaactacattatgtgcactaatagtttagcgtcgtgaagactttattgtgtcgcgaaaagtaaaaattttaaaaattagagcaccttgaacttgcgaaaaaggttctcatcaactgtttaaaaggaggatatcaggtcctatttctgacaaacaatatacaaatttagtttcaaagatgaatcagtgcgcgaaggacataactcaataggaaaaaaccgagcttcctttcatccggcgcggctgtgttctacatatcactgaagctccgggtattttaagttatacaagggaaagatgccggctagactagcaagttttaggctgcttaacattatggataggcggataaagggcccaaacaggattgtaaagcttagacgcttctggttggacaatggtacgtttgtgtattaagtaaggcttggctggggatagcaacattgggcagagtatagaagaccacaaaaaaaaggtatataagggcagagaagtctttgtaatgtgtgtaacttctcttccatgtgtaatcagtatttctacttacttcttaaatatacagaagtaagacagataaccaacagcctttcccagatatacatatatatctttatttcagcttaaacaataattatatttgtttaactcaaaaataaaaaaaaaaaaccaaactcacgcaactaattattccataataaaataacaacatggcggcacttccggacgttgcctccattcccatccctctggtggcaaccctaggcattgcccctctaattttctatctcgtccttgatagaattagccccttgtggccaaattccaaagctttcctgattggcaagaagaaaccggagaccgtgacatcgttcgagtgcccatatgcctacatccgtcagatctatgggaagtatcactgggagccattcgtacagaagctgtctccgaggcttaaggatgaggatccggccaaatataagatggttctggagataatggatgcaatccacctgtgtctgatgctagttgacgatataactgacaatagcgactatcgaaaaggcaagccagcagcccaccggatatatggcccttcagagacagcaaatcgcgcttactaccgagtcacccagattctaaacaagaccgtgcaaaagttccccaagctggccaagttcctgcttcagaatctggaagaaattctcgaaggccaagacctgtcactaatctggcgacgggatggactgggtagcctttcgactgttcctgatgagcgagttgcagcctatcgcaagatggcgtcattgaaaactggggcgttattccggctgctggggcaattggtgatggaggaccaatcgatggacgggacgatgactactcttgcgtggtgctctcagctgcagaatgactgcaagaatgtctactcatctgaatatgctaaggccaaaggggcgcttgccgaagacctccgaaatcgagagctctcatttccaattatcctcgcgctggaagctcctgaagggcattgggtcgccagtgctttggagaccagctcaccgcgcaacattcgcaaggcgcttgctgtgattcagagtgagagagtgcgcaatgcttgtttcaaggagctcaagtcggcgagtgcttcggtccaggactggttggctatttggggacggaacgagaaaatgaacttgaagagccagcagacgtagagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacctccattgggccgatgaagttagtcgacggatagaagcggttgtcccctttcccggcgagccggcagtcgggccgaggttcggataaattttgtattgtgttttgattctgtcatgagtattacttatgttctctttaggtaaccccaggttaatcaatcacagtttcataccggctagtattcaaattatgacttttcttctgcagtgtcagccttacgacgattatctatgagctttgaatatagtttgccgtgattcgtatctttaattggataataaaatgcgaaggatcgatgacccttattattatttttctacactggctaccgatttaactcatcttcttgaaagtatataagtaacagtaaaatataccgtacttctgctaatgttatttgtcccttatttttcttttcttgtcttatgctatagtacctaagaataacgactattgttttgaactaaacaaagtagtaaaagcacataaaagaattaagaaaatggccaatgcccagcaacccccctttcgcatccttattgtgggcggttctgtcgcaggcctcatccttgcgcactgtctcgaacgcgccaatatagagtacctcatactcgaaaaaggagaagatgttgctccacaagttggtgcctcgataggtatcatgccaaatggcggacggatcctcgagcaactgggcctatttggggagattgagcgtgtgatcgagccgttgcatcaggcgaatatcagctatccagatgggttctgctttagtaacgtctatcctaaggttcttggcgacaggttcggatacccggttgcattcttggaccggcagaagttcctgcagattgcatatgaggggctgagaaagaagcagaatgttctcaccggtaaaagggtagttggactgcgacagtcggatcaagggactgctgtttctgtggctgacgggacagagtatgaggcggatctcgtggttggtgctgatggagtacatagtcgggtgagaagtgagatttggaagatggcggaagagaatcagcctgcatcagtttcgacacgtgaaagaagaagcatgactgttgaatatgtctgcgttttcgggatttcatcagccatcccagggctcgagataagcgaacagatcaacggtattttcgaccatctatccattctaacaatccatggcagacatggtcgcgtgttctggttcgtgatccagaagctggataggaagtacgtctatcctgatgtcccgcgattctcagacgaggatgccgtacagctcttcgatcgggtcaaacacgtgcggttctggaaaaacatctgtgtgggggacttgtggaagaacagagaggtgtcctcgatgacagcgctggaggagggagtgttcgagacatggcatcatgataggatggttttgattggagatagcgttcacaagatgacgcccaactttggccaaggagctaattcagccatcgaggatgctgccgcgctctcttcccttctacatgatctcgtcaacgcccgtggagtttgcaagccatcgaatgtccagattcagcatctcctcaagcagtatcgggagacccgatacactcgcatggtaggcatgtgtcgcaccgcggcttcagtctctcggattcaggcccgagatggcatcctcaacaccgtctttggacgatattgggcaccttatgctggcaacctgcctgctgacctggcatcaaaagtgatggcagatgcagaggttgttacttttctgcccttgccagggcgctcaggaccgggctgggagatgtacagacgaaaggggaagggagggcaggtgcaatgggtgcttataatcttaagcttacttacgattggtggattgtgcatctggctacaaagcaatgcgttgagtagataaggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgacagtccaaatgttgatttatcccagtccgattcatcagggttgtgaagcattttgtcaatggtcgaaatcacatcagtaatagtgcctcttacttgcctcatagaatttctttctcttaacgtcaccgtttggtcttttatagtttcgaaatctatggtgataccaaatggtgttcccaattcatcgttacgggcgtattttttaccaattgaagtattggaatcgtcaattttaaagtatatctctcttttacgtaaagcctgcgagatcctcttaagtatagcggggaagccatcgttattcgatattgtcgtaacaaatactttgatcggcgctatgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagattaattaa

SEQ ID NO: 66 - DNA, 14644 bp, Artificial Sequence
  Description of Artificial Sequence: Synthetic polynucleotide
atagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatgctgggattcccaatgttcaacccagctacgcctgatgtctggaagatgaataccccttactttccatttgttacaccggggttatttcctgcctcagcacccccatcgcccaccaacgtagatgccgaagctgccagttcccaacagtcggaagcaagctatctggataaggagaaaattgttcgagggccacttgattatcttctcaaatcccctggaaaagacattcgtcggaaattcattcacgcgttcaatgaatggctgcgcattcctgaggacaagttgaatattatcacggaaattgttggattgcttcacacggcctcccttctaatcgacgatattcaggacaattccaagcttcgacgcggcctcccagtggcccatagcatatttggtattgcgcagacaattaactctgccaattatgcgtactttctagcccaggaaaggctccgcgaactgaatcatcctgaagcgtacgaaatatacacagaggaactgcttcgtctgcaccgcggtcaaggtatggacttgtactggcgggactgcctaacctgtcccacagaggaggactatattgagatgatcgccaacaagactggtggcctatttcgactggcgattaagcttatgcagttggaaagcactttgtgcagcaatgtcattgaactagcagacttgttgggcgtgatctttcagattcgggatgattaccaaaacttacagagtggactatacgccaagaacaagggattttgcgaggatttgacggagggaaaattttcctttctgattatccacagtattaacagtaacccgaacaatcaccatctgctaaatatactacggcagcggagcgaggacgattcggtgaagaagtatgctgttgattatatcgactcgacggggagttttgactactgccgggaacggctcgcttccttattggaagaggcggatcaaatggttaagaagttggaaaatgaggggggacaatcaaaggggatctacgatattctgagctttctgtcgtgagcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcgcatgccagcattgaaatgatcgaagttcaatgatgaaacggtaattcttctgtcatttactcatctcatctcatcaagttatataattctatacggatgtaatttttcacttttcgtcttgacgtccaccctataatttcaattattgaaccctcactgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaaatggatgggttcgaccattctactgctccaccaggatataacgagctaaaatggctcgccgatatcttcgtcatcggaatggctgttggctgggttgctcactatatggagatgattcacacgtcgttcaaggaccaaacatactgcatgaccatcgggggcctttgcatcaattttgcctgggaaatcatattctgcacaatgtatcctgccaaaggatttgtcgagcgggttgcctttctcatgggcatttctctcgaccttggggttatttacgcgggaatcaagaacgccccaaatgaatggcaccactctgcaatggtgagggaccatatgccccttgtcttcgcagcaacgacactttgttgtctgagcggtcatatggctcttactgcccaggttggtcccgcacaagcctatacgtggggggcaattgcatgccagctctttatcagcatagggaatgtgtttcaattgttgagtcggggaaacacacgaggggcgtcatggacgctatggacctccaggttttttggatcaacatcagccattggctttgctcttgttcgatatattcgctggtgggaggccttttcttggttgaactgcccgcttgtgatatggtccgtggccatgttctttctgtttgaaacactctatggagccctattctattctgtcaagcgacaagaagggagatcccagcgtggaatcaagcacaaagagaggtagacaaatcgctcttaaatatatacctaaagaacattaaagctatattataagcaaagatacgtaaattttgcttatattattatacacatatcatatttctatatttttaagatttggttatataatgtacgtaatgcaaaggaaataaattttatacattattgaacagcgtccaagtaactacattatgtgcactaatagtttagcgtcgtgaagactttattgtgtcgcgaaaagtaaaaattttaaaaattagagcaccttgaacttgcgaaaaaggttctcatcaactgtttaaaaggaggatatcaggtcctatttctgacaaacaatatacaaatttagtttcaaagatgaatcagtgcgcgaaggacataactcaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggcggcacttccggacgttgcctccattcccatccctctggtggcaaccctaggcattgcccctctaattttctatctcgtccttgatagaattagccccttgtggccaaattccaaagctttcctgattggcaagaagaaaccggagaccgtgacatcgttcgagtgcccatatgcctacatccgtcagatctatgggaagtatcactgggagccattcgtacagaagctgtctccgaggcttaaggatgaggatccggccaaatataagatggttctggagataatggatgcaatccacctgtgtctgatgctagttgacgatataactgacaatagcgactatcgaaaaggcaagccagcagcccaccggatatatggcccttcagagacagcaaatcgcgcttactaccgagtcacccagattctaaacaagaccgtgcaaaagttccccaagctggccaagttcctgcttcagaatctggaagaaattctcgaaggccaagacctgtcactaatctggcgacgggatggactgggtagcctttcgactgttcctgatgagcgagttgcagcctatcgcaagatggcgtcattgaaaactggggcgttattccggctgctggggcaattggtgatggaggaccaatcgatggacgggacgatgactactcttgcgtggtgctctcagctgcagaatgactgcaagaatgtctactcatctgaatatgctaaggccaaaggggcgcttgccgaagacctccgaaatcgagagctctcatttccaattatcctcgcgctggaagctcctgaagggcattgggtcgccagtgctttggagaccagctcaccgcgcaacattcgcaaggcgcttgctgtgattcagagtgagagagtgcgcaatgcttgtttcaaggagctcaagtcggcgagtgcttcggtccaggactggttggctatttggggacggaacgagaaaatgaacttgaagagccagcagacgtagagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgataccttatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaatggccaatgcccagcaacccccctttcgcatccttattgtgggcggttctgtcgcaggcctcatccttgcgcactgtctcgaacgcgccaatatagagtacctcatactcgaaaaaggagaagatgttgctccacaagttggtgcctcgataggtatcatgccaaatggcggacggatcctcgagcaactgggcctatttggggagattgagcgtgtgatcgagccgttgcatcaggcgaatatcagctatccagatgggttctgctttagtaacgtctatcctaaggttcttggcgacaggttcggatacccggttgcattcttggaccggcagaagttcctgcagattgcatatgaggggctgagaaagaagcagaatgttctcaccggtaaaagggtagttggactgcgacagtcggatcaagggactgctgtttctgtggctgacgggacagagtatgaggcggatctcgtggttggtgctgatggagtacatagtcgggtgagaagtgagatttggaagatggcggaagagaatcagcctgcatcagtttcgacacgtgaaagaagaagcatgactgttgaatatgtctgcgttttcgggatttcatcagccatcccagggctcgagataagcgaacagatcaacggtattttcgaccatctatccattctaacaatccatggcagacatggtcgcgtgttctggttcgtgatccagaagctggataggaagtacgtctatcctgatgtcccgcgattctcagacgaggatgccgtacagctcttcgatcgggtcaaacacgtgcggttctggaaaaacatctgtgtgggggacttgtggaagaacagagaggtgtcctcgatgacagcgctggaggagggagtgttcgagacatggcatcatgataggatggttttgattggagatagcgttcacaagatgacgcccaactttggccaaggagctaattcagccatcgaggatgctgccgcgctctcttcccttctacatgatctcgtcaacgcccgtggagtttgcaagccatcgaatgtccagattcagcatctcctcaagcagtatcgggagacccgatacactcgcatggtaggcatgtgtcgcaccgcggcttcagtctctcggattcaggcccgagatggcatcctcaacaccgtctttggacgatattgggcaccttatgctggcaacctgcctgctgacctggcatcaaaagtgatggcagatgcagaggttgttacttttctgcccttgccagggcgctcaggaccgggctgggagatgtacagacgaaaggggaagggagggcaggtgcaatgggtgcttataatcttaagcttacttacgattggtggattgtgcatctggctacaaagcaatgcgttgagtagataaggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgacagtccaaatgttgatttatcccagtccgattcatcagggttgtgaagcattttgtcaatggtcgaaatcacatcagtaatagtgcctcttacttgcctcatagaatttctttctcttaacgtcaccgtttggtcttttatagtttcgaaatctatggtgataccaaatggtgttcccaattcatcgttacgggcgtattttttaccaattgaagtattggaatcgtcaattttaaagtatatctctcttttacgtaaagcctgcgagatcctcttaagtatagcggggaagccatcgttattcgatattgtcgtaacaaatactttgatcggcgctatgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagattaattaa

SEQ ID NO: 67 - DNA, 4275 bp, Aspergillus fumigatus
atggaagatcaaggtcacttgccatctgaaccaagagctctgtttgatagaagagatgataccgattctactaacactgccttggatgaaactgacttgtccagaactcccttgcaagatacttctcacactccacatgctgaagattggtctttgatgccagacttgaaaaagcaacatgacagaaacgttgcttccggctttaggaggagagaattgggtgttacctggaaaaatttgtctgtcgatgttgtttccgctgatgccgctattaacgagaacgtcttgtctcaattcaacattccacagcacatcagggagtctaggaacaaagctcccttgagaactattttgcacgaatctcatggttgtgtcaaaccaggtgaaatgttgttggttttgggtaggccaggctctggttgtactactttgttgagaatgttgtccaatcataggttgggctataaagccatcaggggcgatgttagatttggttccttgactccagaagaagcttccaagtataggggtcaaatcgtcatgaacaccgaagaagagttgtttttcccaactttgaccgttgctcaaaccttggatttcgccaccaggttgaaggttccatttaatttgcccgatggtgtcacttctccagaagctttcaggcaagaaacccgcgaatttttgttgaaatccatgggtatttctcacacctctgacactaaagttggcaatgagtacgttagaggtgtttccggcggtgaacgcaaaagagtttccatcattgaatgtttggctactaggggttccgttttttgttgggataattctactaggggtttggatgcttccactgctttggaatgggctaaagctgttagagctatgactgatgttttcggtttgtcctccatcgtcactttgtatcaggctggcaacggtatttacgatctgttcgacaaggttttggtcttggatgaaggtaagcaaatttactatggcccaatgtcccaagctagaccattcatggaagaacagggttttgtctgtagggagggttctaatgttgccgattttttgactggcgttactgtccccactgaaagaaaaattagaccaggctacgaaaatcgcttcccaagaaatgccgatgaattgttggctgcctacgaaaaatctcccattagagctcagatggctattgaatatgattaccccgatactgagtccactagagaacgcactgaagaattcaagctgggtgttttggacgagaaagccaaaaggttgtctaagaactccccattcactgtcgatttcttgcaacaagttaaggcctgcatcatccgccaatatcaaatcatctggactgataaggccacttttgccatcaagcaaatttccaccgtcattcaagctttggttgctggctctttgttctacaacgctccagataattccggcggtttgttcattaaatccggtgctttgttcttctctctgttgtataattctctgttggccatgtctgaggtcaccgactctttctctggccgcccagttctgattaaacacaaatattttgcctttttccacccagccgccttctgcatcgctcaaattgctgccgatattcccgtcttgttgttccaaatctctatgtttgccgtcgttgtttacttcatggttggtttgaccacctccgctggcgctttcttttcctattggatcattatctttgtcgctactatggttatgaccgctttgtttagggctatcggtgctttgttctctactttcgatggcgcttccaaggtttctggttttttgatctccgctttgatcatgtattgcggttatttggagccctatcatgctatgcatccctggttcatctggatctattggatcaatcccctggcttatgctttcgatgctctgttgtccatcgaatttcacaacaagattattccctgcgttggcaataatctggttccattcggtccaggttatgatgacaccacttttcaatcttgcgctggtgttggtggtgctgtcagaggtatgacttatgtcactggtgatcaatatctggcctctttgacttactcctactctcatgtttggagaaattttggtatcctatgggcttggtgggctttgttcgttgctgttactattattgctacttctagatggaaatctgctgctgaagctggtaactctttgttgattccaagggaaactgttgccaagcatcatgctgttgtcagaaaggatgaagaggctcaattgaatgaaaaggctggtcataaaggtactggtactgattctgaagcccaatctaacgttgatcaacacttggttaggaacacttccgtcttcacttggaaaaacctgacttacaccgttaaaactccatctggtgatagagtcttgctagacaatgtctatggttgggttaaaccaggtatgttgggtgctttgatgggttcttctggtgctggtaaaactactttgctggatgtcttggctcaaaggaaaactgacggtactattagaggttctattatggttgatggtaggccattgccagtctccttccagaggtctgctggttattgtgaacaattggatgttcatgaaccatttgctactgttagggaagctttggaattctccgccttgttgcgccaaccaagacatattccaagggaagaaaaactgaagtacgtcgatgttattattgacttgctggaattgcatgatctggaacacactctgatcggtagggttggtgccggcttgtctgttgaacaaagaaaaagagttactatcggcgtcgaattagtctccaagccatccattttgatttttctggatgaacccacttctggtttggacggtcaatccgctttcaacactgttaggttcttgagaaagttggctgatgttggtcaagctgttttggttactattcatcaaccctctgctcaattgttcgccgaattcgataccttgttgttgctggctaaaggtggtaagatggtttatttcggcgatattggtgataacgctcaaactgtcaaggactactttgccagatatggtgctccatgtccagctaatgtcaatccagctgaacatatgattgatgttgtttccggtcacttgtcccaaggtagagattggaatcaagtctggttggaatctccagaacattcttctgcctctagagaattggattccattatttctgaagctgcttctaaaccaccaggtactgttgatgatggttacgagttcgctatgccattgtgggaacagactaagatcgtcactcaaaggatgtccacttccctgtataggaactgtgattacattatgaacaagattgctctgcatatcggttctgctctgttcaacggcttctctttctggatgatcggtgactctgttgctgatatgcagttgaaattgttcaccatcttcaacttcatttttgtcgctccaggtgttatcaaccagctgcagccattgtttatcgagaggagggatatctatgatgccagagaaaaaaagtccaagatgtactcttgggtcgcttttgttaccgctttgattgtctccgaattcccatacttgtgcgtttgtgctgtcttgtatttcgtctgttggtattataccgtcggtttcccctctgattccgacaaggccggtgccattttctttattatgttgtgttacgagtttttgtacaccggcattggtcaattcatcgctgcttacgccccaaatgctacttttgctgctctgaccaatccattgattctgggtactttggtttctttttgcggtgtcttggtcccatatgctcaaattcaagctttttggcgctactggatctattggttgaacccctttaactacttgatgggttccatgttggttttttccgtctttgacaccgatgtcaaatgtaaggaaggtgaattcgccgtttttgatactccaaacggcactacttgtgccgattatttgtccacttatttgcaaggtgttggttctagagccaacttggttaatccagaagctacttctggttgtagggtctgccaatacagatatggctccgattatctgtacaccatcaatttgaaggattactactacggttggagagataccgctattgtctgcattttcgtcctgtcctcttatgctttggtctatgctctgatgaagttgagaactaaagcctctaaaaaagctgaatga

SEQ ID NO: 68 - DNA, 1830 bp, Aspergillus fumigatus
atgccatcttggactagaactccagcttgtttcagaagacaattttctaggttgccaggtccctctccattgtcctcttctagatctaggttctctggcttgatttttaccgttgccggcgtcgttatttccttgttgtacctgttctatgtctttgttgtcccccagctgttgagattcagattgagattggatctgtccccctatgacttgggcttttatggcttgggtccatctagatcttacgcctcttttgagtatgaatctccagtcgttgaaatcactgaatgggcttccggttgtgattccagatacacttttttggctccaaggggtgattctgttgctcatccaggtccagttattttggatgctgatggtgaattggtctggatgaagtacaactgggataccacccaggatttcaaggttcagagatacaatggtgctgactacttgacttactgggaaggtactgaagttgaatctagaggctccggttcttggtacatgttggattccacttacacccaaaagtatcagatctctccaattggtaactttggtggtggcgatttgcatgagttccatatcaccgagcaaggtactgctttggtcactgtctatgacccaattccagccgatttgacttctattggtggtccagaattgggttggattttggatggtgtcttccaagacatccatattgaaaccggtgagttgttgttcgaatggagagcttcccaacactatcccgttacttcctcttacgaagctttggacggtgccggtaaagataggaacaacgcttttgacttctttcatattaactctgtcgacaaggacgaacaaggcaactacatcgtctctgccagacatctgcacgccgtttcttacattgaccatgttactggtaacgtcttgtggaccttgggcggtaagttgaacgaattcactgacttgtctcatggtcaggctactaattttgcttggcaacacgacgccagatggcatgctaacaatactatcaccctgttcgataacgctgctcattctaactctgatccagattctgaatctaggggcatggtcattcaactggacctgtctcaaagaactgccgaattgttggctgcttactaccatccacaacaaatgagatctgtttctcaaggtaatgtccagatcctggacgaatccggtagagttttggttggttggggtcattctgctgctttcactgaatatactgctgatggtgacttgttgtgcgacgttcatttcgccgcttctgctttcttttctttcggtagagttgtttcctatagggcttccaaatctacttgggttggtaggccattgactattccagatgctgctgttatgggtgacagagtttacgtttcttggaatggtgctaccgaagttgttgcttggagattggaagtttgggacgctagagctgttgaaggttctacttttgatgttgttgcccaattcgctaagactggcttcgaaactgtcattgagatcccagaagaattgggttccccattgttcagactagctgctttggatgctgaaggtaatgctctgggttacactgaaatcttgcagaaagatcagggtgtcgatgtcgatgaattgttggatctgcataactggatcgtcgctgctgctttcattatttctgtcggtggtttgctgttgggtttgtatcaatgctgtggttgttgccaaattctgcccaggtgtagacgcagaccaaatgaataccaactggttgcttttggtgataacgataatggtgagaatgatccagtttga

SEQ ID NO: 69 - DNA, 1164 bp, Aspergillus fumigatus
atggcttctttaagaccatctgtcaaaagactgttgagacaaccaccatgtagactgtactccggtgctccatcttcttcttctagattgaacctgccaatcgattacaaatccactccattgttgcatcatacttcctcctctttgtcctctgccttggaactgccaggttctactacttccaaatccttgaacttgtaccaggctatcaattccgctttgagaaccgctttggctaccgataatagggtcatgttgttcggtgaagatgttgcttttggtggtgttttcagatgctctatggatctgcagactgagttcggctccgaaagagtcttcaatactccattgactgaacaaggtattgttggtttcgctattggtgctgctgctcagggtatgaagccagttgctgaaattcaattcgccgattatgtcttcccagctttcgaccaaatcgttaacgaagccgctaagtttaggtacagggaaggtggtactggtgttaatgttggtggtatggttgttaggatgccatgtggtgctgttggtcatggtgctttgtatcatactcaatctccagaagctttgttcgctcatgttccaggtgttcaagttgttatgccaagatccccatcccaagctaagggtttgttgctgtctgctattttccagtctaacaaccccgtcatcttcatggaaccaaagattttgtatagagccgccgttgagcatgttccaaacgagttttacactctgtccttgaacaaagctgaagttgtcaagccaggtaacgacgttactgttgtctcctacggtcagccaatgtatctgtgttccgaagctattagagccattgagaaagatatgggcgcttctgttgaattgatcgacttgagaactatctacccatgggacaggcaaaccgttttggactctgttaagaagactggtagggctatcgttgttcacgaatctatgattaactatggtgttggtgctgaggttgctgctaccatccaagatggtgcctttttgagattggaagccccagttaaaagagttgctggctggtccactcacactggcttgacttttgaaaagttgattttgccagatgtcgctaggatctacgatgccatcaagcaaactttggaatattga

SEQ ID NO: 70 - DNA, 2538 bp, Aspergillus fumigatus
atgtccgaaacccaccatgataatgaatcctatgaactgttgactaaccccgaatctttggaacccaccgctatcgaaaatagaaataggcacgatagatccctgtctcaaccagctaatgctgaggctagagaatctcatcatttgggtttgccaggtgaattgtctagaccacatagagttagattcagatctatctcccagcacagggacgttgataacactgacactaccgaaaaagtctactccaactcttctgattcttccactaggactttgttgaattctgctccacgcgccactgatgtcaccgatatgttgaaggctgaacaattcgatgatgaaactgatatttcctccaggtacgatggttccggttacacttctgctaattatccaccatccactccagaaaggatttccgaagactctactacccgcgaaagaaccccaaataggtctaaatccgttaaacaaagatggagggaggctggtcaattgattaggcaaaaaactgttcgcttgggtgaaagattgggtaggccattggatgatggtgaagctttgggtgcttctttgttgccagaagatttggaaggtggtatgccaattagaagagttcattctcaatacaggatgccagctggtgatgatactgatgatgaggataggccaaatccatctgctgaagctcatagattggtcaggagaatgactcaacatactaacttgaggcataggaagcccaaaccagcttatcaaagatctggtcaatctactccagaaaggccatcttcctggtatgattcttatcgcccattgtctttttctggtggtggcggtattttgtctcaattgttgaaattgcaggccgctcagaatgaaaaggatggcttgtctgctactgacgattctgataatggttctccaatgtcttctggcgctactactccaaaatctggttctgctactccaaaatctggtgctgctactccaaagaaggaaaaggtcaagtggtataagaagccacatcataggtccactgcttccttggttgaagcttctatgaatttgtctagggctactttgccctcttctgctgacgtcttgtctatgactcaacaaaagaggggtaaaaagaaagcctacaggaagcataggttggaagatgaaattaaggtcactgtccacatcgccgaaatcctggctaggcataggtacattatgcaattgtgtagagctttgatgagatatggtgctccaactcataggttggaggaatacatgaccatgactgctagggtcttggaagttgaaggccaatttttgtacctgccaggctgtatgattatgtctttcgatgacccagttactagaactgccgaagttaaactggttaggtctactcaaggcgttgatctgggtagattggctgaaactcataacgtctacaagaatgtcgtccacgatttgattggtgttgaggaagccatccaagaattggacgagatcatgaagagaaagccacgctttaataagtggatcttggtcccagtttatggtttggctggtgctgctgttggtccatttgcttttgatgctaggccaattgacatgccaatcattttcattttgggctccttggttggcttgatgcaacatgttatctctccacgctctactctgtactctaatgtcttcgaagtcactgccgctgttttgacctctttcttggctagagcttttggctctattagaattactgttgacggccagaaacagttcttgttttgcttttccgctctggctcaatcttctattgctctgattctacccggtttcatggtcttgtgctcttccttggaattgcaatctcaccaaatgattgctggttctatccgcatggtcttcgccattatttactctttgttcttgggttatggcatcactgtcggtactaccgtctatggtttgatcgatggcaatgctacttctgaaactacctgcagggacttgtctatttacggctccaaatacattcagcactttatcttcgttcccatcttcgttatctgcctggccgtcatcaaccaagctaaatggaagcaagtcccagtcatgatctttatcgctacttgtggttacatcaccaattatttctccaccactaagttgggttctcgctctgaagtcgccaatactgttggtgcttttactctgggtactttgggtaacttgtactctagattgtggcatggtcatgccgctactgctattttgccaggtattttcgttttggttccatctggcttggcttcttctggctctttgattgctggtattaattacgccaaccaagtccgcgaaaacttgcataaatctggtaacggtaccgatacctcttcccaagatacttccattgcttctttgggttttggtatgattcaggttgccatcggtatcaccgttggtttgttcattgctgctttggtcgtttatccattcggtaagagaagatctggcctgttctctttttaa

SEQ ID NO: 71 - DNA, 756 bp, Aspergillus fumigatus
atgcattacgcttacatttctattccattgactttggctttgggtgttactgcttccatgccagctgactcttgggtcttcggtaactccttgttttacctaggtccaccaactggtgcctctattactaaggctacttattccctggttccaccagatgttccatctggtgttaaggtttcttctccatctgatcaggtttgggtttctgtttgggtcggtgcttcttccaccaacggtgatgctaatgccaacttgtaccaaccattgttgaactggtcaccagatcaagaatctcaaggttgctctgctaattccactgaatggtgtgttgctgcttctacctacactccagatggtcaagttggtcaaacttacgttccagttccaccacaaactaacttggacttcgagatttccgtcgagaacaacaaggtttaccagaccgttaccgtcaacggtgaagttgtctctcaacaatccgatgctctggataacgacttgaaatacttgtactcctccaacgaatgttacaccggttctggtaactgtggtctgctgcaaggttacaagattaccaacgtcaccgttactttgtccgctgctgatgaatctttcggtaagactatggctttgttctcttgtactgatgctggcttcgctactaccgataacggcaggacctggtacactgattacattgccatccaagaaattgctttcgattcttcctccgatgcttctgttcaagaataa

SEQ ID NO: 72 - DNA, 540 bp, Aspergillus fumigatus
atgccatggtcttttactttgccacaagaatttttcacctctccagttttggctgttgccactccaattggtgttggttctttggttggctacttggtcaacaggttgggtcataccaaggagttgtactctaggttgagacaaccaccattaagaccaccagcttgggtttttggtccagtttggactgttttgtacggtatgatgggttatgctgctcaccatgctactgcttctactactttgttgactccagctactgctgttgcttcctttcaaaccttgtacaccactcaactggtcttgaactacctgtggatgccattgttcttcggtgctagaaaaccaggttgggctttggctgatattgttgctttgggtggtactgttggtaagttgatggctatgtggtgggattttgatagaactgctttctggatgatgttgccatacgccggttggttgtgttttgccgcttacttgaacgtttccgttggttggttgaataactgggactttgattctagagatggtagatag

SEQ ID NO: 73 - DNA, 1266 bp, Aspergillus fumigatus
atgacttctactgaaaaacaatttactgttgccatcgttggtggtggtattggtggcttggctttggctgctggtttgttgaggagaaacgtcccagttcaaatttatgaagccgctccaaaatttaaggaaattggcttgggtttgaccatcggtccagctgctcacagagctatgccattgattgatccccaaatccgccatgtttacgattctttgattactacccatgccgattctccaggttacgagaggttcaaacagacttggtttgaagtcgtttgggcttccggtccaaagtctggtcaagtcttgatgaatttgaaagctttgccatccggtcaaactactgttagaagagctgacttcttggatgccttggttggtttggttcccccagaaatcgctcattttggcaagagattgatcagattggttgaatctccaactggtgttcacttgtactttgaggatggtacttccgcttctgctgatgtcgtcgtcggttgtgatggtattcattccaaggtcaaggaatttatgttgccagatgaatatgagcaaactatgccaaggtattccggcatgtacggttacagggctgtcctggatatggaaactatggttgaagctgttggtgatcatagagctagagttgctactatgtacgtcggcgatggtgcctatggtatttcttacccaatcatgcacgccaagaaagttaatgttggtttgtacgtcttgcatgacatgtgggatgatgctgcttgggttagacaagcctctaaggaaaatatggccagagacatgaagcacatgggtgagtacgttaacagattggtcgaatgggccatttttgaccatccacacttgtctactttcgctcgctctagaattgctattttgggtgatgctgctcatgcttctactccacatcaaggtgctggtgctggtcaagctattgaagatgcccatgtcttggctgaattgttgggtgatagaagagtcatcgaagctagagatgttttggccgctttccaagcttatgatgaagttcgtagaccaagatctcaaagagtcgtcacctcttctaaggaaaacgcttacttgctgtgtctgcacttgcatggtgtcgaacatgatgaagagaaactgagaaccaccttccaagagaggttgaggtggttgtgggatattgatatccaggatcaagctgagagagccagaagaattatgctgaaaaagatgcagaactcctcttcttga

SEQ ID NO: 74 - DNA, 2538 bp, Aspergillus fumigatus
atgtcggagactcatcatgataacgaaagttacgagttgctcaccaatccagagtctttagagccaaccgccattgaaaaccgcaatagacatgaccgaagtctctcacagccggccaacgccgaagcgcgggagagtcaccatctcggactgcccggtgaactctcacgaccacatcgagtgaggtttcgatctatcagccaacatcgtgatgtcgacaatacagacactactgagaaagtctactcgaattcctccgacagctccacccggacgctgctcaattctgcaccacgagccacagacgttaccgatatgctaaaagcagagcaattcgatgatgagacagatatatcatcgagatacgacgggtctggttacaccagcgcgaattatccgccttcgacccccgagcgcatctccgaagactctacaaccagggagcggacgccaaaccgatcgaagtctgtcaaacaaagatggagggaggcaggtcagctgattaggcaaaagacagtccgtttgggagaacgccttggtagacctctggatgacggcgaggcgctgggagcctcacttttgcctgaggacttggaaggtgggatgccaatccgaagggtccatagtcagtaccgcatgcctgctggcgatgatacggacgatgaggatcgacccaaccccagtgcggaggctcaccgtcttgttcgacgaatgactcaacacactaatttgcgccatcgcaaaccgaaacctgcgtaccaacgttctggccaaagcactcccgagcgtcccagttcgtggtacgattcttaccgtcctctatccttcagcggagggggcggaattttgtctcagctgctgaagctgcaagctgcgcagaatgaaaaggatggtttgtcggccacggatgattccgataatggctctcccatgtcctcgggagctacaacgcccaagtcaggatcggccacccccaagtctggtgcagctacacccaagaaggagaaagtcaaatggtacaagaaaccgcaccatcgatcgactgcttccctagtggaagcatcgatgaacttgagtcgggccaccttaccgtcatccgccgatgttctgtcaatgacacagcagaagcgggggaagaagaaggcttatcgcaagcatcggttggaagatgaaatcaaggtgaccgtgcatattgcagagatcctggcacggcatcggtatatcatgcagttgtgccgtgcgctgatgcgatatggtgcgcctacgcaccgattggaggaatacatgaccatgacggcgcgggtcctggaggtcgagggacagtttctgtatcttcctggttgtatgatcatgtccttcgatgaccctgttactcggacggcggaagtcaagctcgttcgttcgacgcagggggtcgatctgggacgattggcggaaacgcacaacgtttacaaaaatgtcgtccatgacctgatcggagtcgaagaagcgatccaggaacttgacgaaatcatgaagcgcaaaccgcgttttaataaatggatcctggttccggtgtacggtctggctggcgccgcggtcggcccatttgccttcgacgcccggccaattgacatgcctatcatcttcattcttgggtcgcttgtcggtttgatgcagcacgtcatatctccccgatccaccctctattctaatgtgttcgaagtgacagcagcagtgctgacctcgttcctggcacgcgcattcggctcgatccgtataactgtggacggtcaaaaacagttcctcttctgcttctccgctctggcacagtcctccatcgccctaattttaccgggtttcatggttctgtgcagcagtctcgaactccaatcccaccagatgattgcaggttctatccgcatggtcttcgctataatctattccctcttccttggctacggcatcacagtcggcaccaccgtctacggccttatcgacggtaacgccacctccgaaaccacctgtcgtgacctctccatctacggcagcaagtacatacaacacttcatctttgtccccatcttcgtcatctgcctcgccgtcatcaaccaagccaaatggaaacaagttcccgtcatgatcttcattgccacctgtggctacattaccaactacttcagcacaaccaagctaggctcccgttccgaggtcgccaatactgtcggtgcattcacgctcggtaccctgggtaatctctacagccgcttatggcacggccatgcggctaccgcaattctacctggtattttcgtactcgtgccatcggggctggcctcttcgggctccttgatcgccggaatcaactatgcgaatcaggtccgcgagaatctgcacaagagcggcaatggcaccgacacgagcagccaggatacgtctatcgctagcttaggtttcggaatgattcaggtagcgatcggtatcactgtgggattattcattgcggcgctggttgtatatccgtttgggaagcgccggagtgggcttttcagtttttaa

SEQ ID NO: 75 - DNA, 7683 bp, Aspergillus fumigatus
atgccaattaattcttttgaaggcactggtgaaccagttcaattgccatctgctccagatgtcgatattgaagatggtgcttccaattccttggatgatgcctccatgtctattgctatcattggcatgggttttagaggtccaggtgacgcttccaatgtcgaaaaattgtggaaaatgattctagaaggtagagaagcctggtcccaaattccagaatctaggtggaattccgatgccttctatcacccagatcacgctagacatggtactatcaatgtccagggtggtcactttttgactgaggacgtttctttgtttgatgctccattctttaacatgacttctgacgaagctgctgctatggacccacaacaaaggttgttgttggaagttactcatgaaggcctagagaatgctggtattccattgccagagattatgggttcccaaacttcctgtttcgttggctcttttaacgccgattatactgatctgttgttgagagatccagacgccattccaatgtatcaatgcaccaatgccggccagtctagagccatgatggccaatagagtttcttatttttttgatttgaagggtccatctgttaccgtcgacaccgcttgttccggttctttggttgctttgcatctggcttgtcagtctttgagaactggtgatgctgctatggctattgctgctggtgttaatgtcattctgtcccatgaattcatgtccactatgaccatgatgaaattcctgtccccagaaggccgttgctacactttcgatgagaagtctaatggctatgccaggggcgaaggtattggttgtttgattttgaaaccactgaaggttgccattagggataaagatccaattcgtgctgtcattagaggctctggttccaatcaggatggtaggactccaggtatcactttgccatctggtgcttctcaagaagctctgattaggcatgtttataatatggccggtttgcacccacatgataccgagtttgttgaaactcatggtactggtactcaagctggtgatccaattgaaactggtgctttggccagagttttttgtgtcggtcgcaattctgacaaaccattgaggatcggttctattaaaaccaatgttggccacttggaaggtacttctggtgttgctggtgttatcaaagctgttctgatgctggagaacaggattttcctgccaaaccgcaatttcacttccttgaattccaggattttgctggatgagtggaagttgaagattcaattggatccagagccatgggagtcttctactccacatagggtttctgtcaactcctttggctatggtggttccaatgctcatgttattttggaggacacttatggttatttgcagtctcacggtttgcaagctccagttggtaaaccaaggactccattcttgaaggaagctctggaaccatctcaaaaaccacactctaggcacgatgagtctccaattagaactaggttgtttatgttgtccggttttgacgatcattccctggccaagcaaattgagaacattcgcgtctacttgagagagagggaatccattgctgacgatcaatttatgtctaatctggcttttactctgaaccacaggaggactactttgatgtgcaggactgctgttaacggttcttctgcctcctctgttatcaaagctttgggtggttctattcgcgttagaaaagctactaggaaacccgttgttggttttgttttcactggtcaaggtgctcaatggtgtggtatgggtagagaattggtcaaagcctacccagtttttagacaatccatggaaaggattgacgctcatttgattagattgcaggccccattttccgctctgggtgaaatcttggaaaatcaagatgcttcccgcttgaatcacccattgcattctcagactatctgcactgccttgcaaattgctttggttgatttgttgtcctcttggggtattgagccagattctgttactggtcattcttctggtgaaatcgctgctgcttatactatcggtgctttgactatggaagatgctatctctgtcgcttattacaggggcgtcgctgcttctaaattgttgcacaatgacgaagttaaaggcggtatgttggccgttggtgtttctccagctcaaattgctccatttttggataccctgaaatctggtaaggctgttgtcgcttgcatcaattccccatcttctattactgtctctggtaatgttgacgccattgatgaactggaaaaggtcttgaaggaaaaggagttcttctgcagaaggttggtcgtcgatgtcgcttatcattctcaccatatggagttggttggtggtgaatacttggacttgatctctaatattcgcccacaaactggctctaaatctggcaaacatcccgtttcctttttttcctctgttactggtgctggtgttgaagcttctgatttgggttctcagtattggactaggaatttgctgggccaagtcagatttgttgattctgtcagagctttgtgtttcgaaaccggtactcagaagtctatgttcgccgctttgaataacagaagagttagacgcccaaacggtgccaggaaagtcaatgttgatattttgttggaaattggtccacatggtgctttgtcgggtccaattaggcaaattttgaaagaagataataagttgaactctgccggtttgcaatacgcctccgtcttgaccagaaaagccgattccgttactactgctttggaaattgctggtactttggcttctttgggttcccaagttaatttctccgctattaatgatccactggttgaaaccttggatacccaggttatcgttgacttgccaccatacgcttggaatcattctaggccatactgggctgaatctagaatctctactacttttagaaagagaaaacatcccaggattgatcccttgggtgctttggacagattgtcctgtccatttgaaccaaggtggagaaacttcatgcgtgtctctgaaattccatggttgaaagatcataagatccagtctaacatcgtctatccagccgctggctatattgtcatggctattgaagctgcctcccagcatttgttggatcaatacggtaataaagacatgtccgcctttatcctgagggatatcgaaatcaaagctgccttggttttgcaagaaaactctgctgcagaagtcatgacctctttgagagcctggcaaggttctactaaggcttccgaaaggttgtatgaatttaacgtttattctgttactgccgaaaataggtggactgaacattgcaggggcttggttggtgcttccgatttgtccttggatactgaatatgaaacctcttcccaagttcccaagcaagcctctgatttgtctgtcattgatacttccactttctacgaaaagctggcttccattggtttggaatatggtccatgctttgctaatttgactcatgccaaccagactggcaatttgtgtttcgctgaagttactattccagataccgctgctgttatgccaatgaacttccaatatccacacttgattcacccctgcaccttggattccatctttcataccgtttttgttcaaactaatgtcggcgatgatcccgctattccagttcacattgaccaattgtctgtctctagatctgctgaacattccccaggtactagaatgcatattgagactcacattgaaaagaggaccaggaagtctattgtcgcttctatcaccgtcattaactctaacgacaccatcgctatgtccatcaaaggcttgagatgcaagcacttgaagaattctgacccaaaagatatggtcaacccaactgaaaggttgggttatatgttgacctggaaagccgactccgatttgttgtccaagcaagacttctctaccgtctttactgaagacaatcatcacactcaagaatctgctaaaagacaactgttggaaggctgtgccttctcctatatccgcaaagccattcaagatttggaaccagccaataaagaaggcttgcatccaaggaggagggaacaattggacttttttgtcgatagaactcaaaactccagattggtcgcttcttctgtcactaacaatgctgatatccaagctttgtctgcttctggtccagaaggcagattgttgactgccgtcggtgaacaattgtccaccatcttgaaggattccaagttctctaatattgatatggatttgtccatttgggaacagtactgggataccatcaggttgtcccccgtttacgaaaagttggcttcctacttggaattggtcggtcataagaatccaatgatctccattttggaagttgaaggtaccttcggtcaagcttctcaagaccatttggaaaggctgttgggtaataatggtcatggtccattgtgtagagaatataccattactcatgaaggccagtctatccccgaacacttttccccagttgtctctaagtggaaaccattgttgaaagtcaaggaattgaacctgaatcaatcccccgaagctcaaggtttctccaaatatcagtatgacgttgtcctggctccattgggtttgtgtactgttccagctaaattgcaagccttgaggaatattcacgctttgttgaaaccacagggtcatttgatcgtcgttgatcccattgctaggcatgataacttgactgaatccgttatcttcgccaattctttgggttgttggccagaaggtagatttggttataccttggaaggttggaatttggtcttgtctgctgctggtttttctgaagctgaagatgcttccatcccaagagaaggcagatttatgatgattactaggccattgcatggtcaatccatccccaagcagtctatcttgattatttccgaggatgatgataacggtatcgatctatccgctttgcaagactccttgtccccaatgtcttccgatatcgaaattgctgactttactcatgccaaaccaaaaggtagagtttgtatcatcttgtctgctttgtctcgccacttgatggctgacccaaccccagacgaattggaagtttctaaacaaattttcctgaaagcttctggtgttttgtgggttactagaggtgctaccatctctccagttactccagatggtgctttggctactggttttgttaggacttctaggtctgaatctggtattgaaaggatcgtcactttggatttggatggtagaaaacccttgtcttcccatcatgctgccgaaattatctgtaaggttgtcagagaaagaatcctgactgatggtaatggtcaatctgatactgaatatgctgaaagaaatggtgtcttgttgattccaagggttgctgaaaatcaagccttcaacaggtgtttggccgcttctcaggaaacccaaaccactaatttggagaaattccatcaagaaggtaagttcttgaaggcttccatctctgacgcttctcaagaaggcgaagtcttgtttgtcgatcactccaaaggcaatgatattcccgaggatcatattagagtccagatttatgctgtctgcatcgacaaacaagctgctaacgctttggaggaacaagacacttctcaagaactagctatgggttttggtgcttctggtattgttcattctgttggtggtgctgttttggattttgctccaggtgatagagtcgcttgtttggctcaaggcgctgttgctaattatcaacaagaacaagctttggcttttcaaaggttgccagaaggtttgtcttttgaagctgctgctgctttgccagctgcttattgtaccgccttgtatgctttgcaaaatatcggtagggttgtttctactaatagagttctggtctacggtgccactgctactgttggtcaagccttcgctgaattgtgtttgaatatccatgcttacgccttgttcgtcgttagggctgaaaaagataaacactctttgtgctccactattgctgttccaggtgacaggattatcgtcaacgaaaatggcgcccatctgagaaggttgttgagaaaagaatatcaaccattcgacttggtcgtcaattttgaatccagggacaacgagacgctgcaaatgctgtgtagattggttggtactggtggtaaattcattcatttgtaccgcgataaccgctggaatcaacgcactctggctatccccaaattggaaaatgatatcgtctttgctactctggacatccaaaaattgctgagggctcgcccaactttgttgtataagatctggggtgatgttatgcgcatgtacagggctggtcatattagaggttccaatgttttggagacgtactccatttctgacatgagagatgctttgaacgttctggagttgggtgaattggattccctggttttggctgctaaaccagaagatttggttaaggttatgactccaaagccacaagctgctttgttgagggctgatgcttcttacattttggttggtggtttgggtggtttgggtagagctactgctttgtggatggctgataatggtgccagaactttgattttcgttaataggtctggcttgtcttctcaagctgctcaagaaactgctagggatttgaagcagaaaggcgtcagggttattattcacgcttgcgatatctccgactctaagaaggttaagaagatggtcattgagttggaaagaaacgctccaccaattaggggtgttattcaggccgctatggttttgcgcgatactcatattgagaagatgaccattgacgattacttgtctgtcttgaggccaaagtactttggtacttggaacttgcacaggcatttgccagctgatctggatttcttcgtcatgttgtcttccatttctggtattattggcaacgctactcaggctgcttatgctgctggttccacttttctggatacttttgccatgtacaggaattctttgtctttgccagctgtttctttggatttgggtgtcattaccgatgtcggttacctggctggtaatagagccttggaagctaagatggctcatcagggttttcattccactgacactgctactttgatgtctttgattgctgcttctattagagctccctttggcgagggtggtacttctcaaatcattactggtttgggtgaatggagggaaggtcaatctttgggtaatttcgatgctccattgttcgcccacttcaggagacaatttcaacaaaagtccgaagaagatcagtctgacgaatgcattggcaaactacacgaaaacttgagagccgtcaacaatttggaggaggcttctggtgttatttactccgctttgtctggtaaaattgccgctcatttgtctgttcccattgaatctatcgatgcttctcacccaatcaccgaatacggcattgattctcatatggctgtcgaattgaggaattggatcgccaaaactatggaatccactgttccaattctggacattttggcttcctccactttgctggatttggctggtaaaattgcttccaaatctcgtgttgttcacgttgaagagtag

SEQ ID NO: 76 - DNA, 678 bp, Aspergillus fumigatus
atgccattgaagttgttgtgtttgcatggttggggtaccaataccaagatcttgcagtctcagttgaacggcttgatgactgaattgagaagggacaacaccgctactttccattttgtggagggtgatattgactctgttccaggtccaggtattgctggtttttacgatggtccctactactcctactacaagttcccaagatccttgtctgatccagatggttccgaagaagaatctctgttggaggcttacaacttgttgtacgacatcatcgacgaggatggtccattcgatggtattttgggtttttctcacggtggtactctagcctccggtttcttgattcattacgccaagacttacccacatgaaccaccattgttcagatgtgccatcttcatcaactctttgccaccattcaggatggactccggtgaaaacattgtcattgactccgacttggatggttacatcaaggttccaaccgtctccattgctggtgccaaggatccattgttcgaatactctttggctttgtacagattgtgcgatccatctagatctacctctattgtccactccaaggcccacgatatcccaaacgacaagaagaatgttgctttgatggctgctggtatcagaaagttggctattgaagctttggctatttggtga

SEQ ID NO: 77 - DNA, 1290 bp, Aspergillus fumigatus
atgatgaatagtgaacgaaagctccgtgcggcatgcgaccgctgccatgaactcaagaaccaatgcactcgcactggtgggcctgacagtcggtgtgaccggtgtaagaggcttgatatagactgtgtgtataacaccagtgcgcgcatgggccgtccgcgagtatcgcgaccgggttctgagaaccataaaggagcatcatccaccagacactcaaaacgaggtgccgtccaggctggcagccagtgcggtgctactgcagtgccgcttcctgttgatcatgtcgatctagcttcggcagtacacgatagatctggcggttctggatcagatagctcccgcagtctcgaaccagtgctagggcttctagatcctgttcccctctcccaggacttagagctgtattctccagactttgcgcacccggctcacgatgatccaacaggcggacaagggctcggacgtggacatgggcacgcccacagggaatatcatcaagtggagagcctacaacagaaatacaaggaagtgcctgacttctctgaatccgacctggagatgtcagaaaagggaacagcgcctattgttaagactaccggcgcagatgagctcctacggctgcagtttcacctaagcaatctgttaacaggggcgagagaatcgcccacaaggcatcagccggccattgatgaggtcatgatggtctgcaaagagctgctagagctgctccccatctcagctcattgctcctcttcagactgcggtactacaagtaagagtgggattggggcaggacggccattcactccagccagcgtcaatgctggacatcctgatccctgcgacggaattggtcagccaactcaacgaggaggagggcctttccacccactaaggataaactacattgccttcctacaagtcgcgacatcatacgcatacgccttgcagctgctggatcttgctgtggataatctcataagccgtggtggtaatctggccctcgtaagcctgggtaccttcaatcttgcatcccagccggccatgagtacctcggtgggtgcttatatgatttcgagcatggtccatcagctgcgtgatgctattagtgtcttgactcctgaatatcagcatcagcaaaggccaccaccaccgcatgcatcatcaccaaatggccttcgggcggccgctgcgactgcgaacaattcgatacatgttgcggtggatatgatttctcagaaggagacgtctttactcgacaaattggcgcagataatgattaaaccataa

SEQ ID NO: 78 - DNA, 744 bp, Aspergillus fumigatus
atgagcccagaaacgaaacccgccatcatctgccttcacggccacggcagcaacggggagatcttccaagctcagtcccaaaatcttacgcgagtcctatccccccgattccgtttcgtcttcctcgactcgcccatcacaacggcccaaactggcgtcggcgtgccaccctactacgcacacataaagccgtacagacggtggcatcaggacagaaacacaatcgggctatttgatgtcacagcggaagatgtcgagcgtgaacgccgggctgtgcgggattcattgaaggatgttattgagcgtgagcgccgaaatggaccaggggccggggttgttggcgttatggggtttagtcagggaacgagggttgcgacggctgtttgtcttgactctgagctggggagggacatcaggtttgcgattatgatttgtgggatttgtccttcactggcgttgagtgctgctgagacgcaggtatcgcggccgctggatattgttcctgtccatgttcaggggagtggtgatccgtggttggccaaggggacgaggttgtcgaaacagtattttaatcaaaggctcgcgacggtggtcaggtttaaagggaggcatgagattccggtgacgacaagcgatgtgcagaatattgctgaggttatggcggagtattgggaacagaagcgtgacaccgtgctggctgtcgaggttgcgagcgagtttgcggctagaatggtatctgcctaa

SEQ ID NO: 79 - DNA, 1056 bp, Aspergillus fumigatus
atgaacctatggaaattttcagtcggactactcgccgctgtaaagtccgtctggacccgcggcagcccattcgctgcactcacagccctctggccaacaaatgaagagggcaaatttatcattcaatccgaaggcattcggctggcttttacaaaccatggcgcagcccttacaaatctctggctgaataatacccatggcgaggaggtcgatgttttactcggcttggactatgcgaggggttatccgtcccttcagtcaaatccatatttaaatggggttatagataaaggctggggccgacagacctgggacatcgcagtgcatatcagcaacagcattacattcgtgctgttcgataacaggtggaatgggttccctgggatcttcgcctcgtgcgtgacgcacacggttacaccgtatgagtggcgaattgccttcggggttacgccgttactcaaggcaggcccaattaattttagtcagcaagttttctttaatcttgatgggtttaggggtaatgccagcaccagcgatgctagtgatagtacggtgcttaatcataggccgaggcttccttcttccgggatgcgtttcgatgttgatgagtgggggattccgacaggcgatatgaagagtaatagggaggggaaggagtttgacttttggtctgcggataagtttattggcgacgaggttcagaagggtaatgctggatctgatgtgacttacgtgctctcccataaaccgttgggcgacaaggaagacgaacctgtggcaatcctctcctcgaagccatctggtgtcaccatggagctttacacggaccaggacgctctccatgttcacacgtggaacagtgacttggctgggttgcggttgaagaaaggtcaagggcaaggcaaagtcgctcaacacgcagcgatatctctagagatgcaagactggccagatgcagtgcaccatccggagtggagacacagagagacgatttggggtatggacggactctatacgcgatttgcaacgtataagttctcagttgaaagaagataa

SEQ ID NO: 80 - DNA, 1662 bp, Aspergillus fumigatus
atgccacatctattaaagaagctattcactcagtttctttttcagcaacccttcagcatgatctcctttctcgggttatggctgtgtacggttacactagcctcgggaggaatcttccaccaggctctcgctggcggtgagcatacagcattgcatttccaagtgctaggtgctcatgtggttgcctttgttgcctttgctgtgtattggatgatcctctacccccgttattttacccccttcggcaacatccccactccttcgcgtcgaagaattctgacagggaactacccagtcctgttccccgataacgcatgggttcctctgcgagaacttgccgaaaccacccctaacgacggtctactacgaatctactctgcgttgagcggcgaggcccttctggtgacaagcccgccagccatcagagacatgctcacagtcaatgcctttgacttcacccaccaggacctcgtcaagattgctatcagacgattcacaggtagcaatcttgagagaacacagctccatcgcaaaaacatgatgccagcattcacagtcccgcacgtccgaaaattaaccagcatcttctgggccaaagctcaggaaatggtgcgctgcatgtcgaacgagctccgcgcagactccttcgcccggatcgacttccgcgagtacatgtctagggctacactcaataacatagggcttgcggggatgggccacgatttccagacgctcaaacagccagatactgacctgcgcagccaccacaggaaactgatcctcgacccgactcgcgtttttagctgggtggggctgctgagtcggtacttcgacatgagactattgatgagggtgccgcttaagaagttgatcgagatctcgcaatcggcgaagtacctccgtgaactcacgacggcggttattcaagggagaagagagcagctggttgtggctgagaacaacaggggtaaggatatcatcactgttgctctcgcaggcggtgtttttgacgaacaccatctagtcgaccacgtcatgacctttttaaccgcaggacacgagtccacagctacggcttttgaatggacgatgtacgagctaggacgccgaccggagatgcagagccggttaagagacgagctgcgagcgacaataggcacagatctggcggccgttaactttggattacgggtccagaatctgccttacttgaatgcattctgcagtgaagtgctccggtgctatcccttctcgccgattatcgtaaaagttgcacaaaaggaaaccatgcttattggccagcggattcccaagggcactgttgtgctttactcggccgaggtgtcgaaccatgacaagaccctttgggggcctgatgcggataagttcgatcctgagcggtggatgggcgcgaagaaggcaaagtctggtggtgcttcgagtaattatgcgatgcttacatttggcgcgggtccacggaactgcattggagcgaattttgccagggcgacgcttgagtgtcttgttgcggcagtgttgtctacgtttgagatcgagcttgcgaatcctgatacggcggggaggttgaagtttgggcagacgaagaagtcggcagaaggcatttacggaaggcttaagtttgtacaacctgtggaagtctaa

SEQ ID NO: 81 - DNA, 7194 bp, Aspergillus fumigatus
atgaaccaatcgccattatacgcatgggctgccgtttcccaggtgaagccagctccccctccaaactctgggacctcctccacaacacgcgcgatgtctcccgtgacatccccattcaacctagaccgcttctaccacccaaccggcagccatcacggtaccaccaacatccgccaggcctacctcctttcagaagacgtgcgcgcgttcgatgcaaaattcttctccgtccccccaggtgacgcagaggccatcgaccctcagcagcgactgctcctagaagtcacttacgaggctctcgaatcatcaggccatacgctggccgacctgtccaactcgaatacgggagccttcgtcggcctcatgtcccaggactacttcgcgcttaatggccaggatgtagactcagtccccacttacgctgcgtctggtacggcggcgagtaatgcttcgagccgactctcttactttttcaactggcatggcccgtccatggcaatagataccgcctgctcatctaatctcgtcgctgtgaatgaggcagtccaagcccttcgaaacggcacgagccgcgtcgctgtagcttgtgggacaaacttgtgtttgtctgcgttcacgtttatcacattaagtaagctcagtatgttgtcaccgacctctcgatgtcacatgtgggacgccgacgcagatggctacgcccgaggtgaaggtgttgcttgcgttgttttgaaaaccctcagcgatgcgatttcagacagggaccctatcgaagccgtgactcgggaagtgggcgtgaatcacgatggcaggacgaaggggttgacaatgccaagtgctaaggcccaggcggcgctaattcgtaacacttatgcacgcgctgggctggatccaacgaaggaggctgatcggtgtcagtatttcgaagctcatggcacgggaacgaaagctggagcgttttttccacagtctgactcagaaggcgaactattcgtcgggtctatcaaagccgtgatcggccacaccgaaggcacagcgggactggcaggtcttatgaaggcttgtcttgctcttcgcaatgcaaccttcccccccaatttactctttaataaattaaaccctgaccttgaactgttcacaagtcatctccgtgttcccacggccaaccaaccttggcctgaatttgtcaacagctttggccttggaggtaccaacgctcactgcattcttgaaacgtacaatccaccaacagccagtgacccagtcattgaaatagacatggccgcatcaggaacatgctgtattccatctgtattctctgcagcatctgatagatcattggcgacactcttgcagtccacactaaaattcatggacgagaataccgacgttaacatgagtggactggcatataacttgagcaccaagcgatctgccctgcagcgaagacttgcagtctccgctacatcgatcgacgaacttcgtgacaagatcaagtccacgatagaagccgcgtcagagaatgacgccactttgcactccacttctgctttacccgaacctgcttcattgcttgggattttcaccggccagggcgctcagtggcaaggcatggggtcccagttgatatcgtcgatacccactacccccgtcggtaaagcctctctttcgcagcctctctgcacggctgtccaagttatcctggttgacatgctccgcgctgcgggagtcaagttccaggccgttgttggacattcctctggggagattgctgctgcctatgcggcaggctttatatctgcatgggacgctatccgcattgcagactaccggggattctacgctgaaatggcggcagcgcctggtggggaaaagggtgcaatgctggctgccggcacctcttttgaggatgctagcgacctttgccagcttgatgactttgccgggaggatctgcgtggctgctcataactctcctagcagcgtgactctgtcgggtgatatcgacgctatagccttggcacggagggtgcttgaagaagaggagaaatttgcccggcgattaaaggtggacacggcatatcactcgacacacatgcataaatgctctgtaccttaccttacggcattgagaaactgcaacatacaagtgcagcagcccggccctgatgcaccgcagtggtttagtagtgtccgaaacggtcaggtcatcagcagcatggaaagcttggacagtcaatactgggtcgataacatggtacagcccgagctattctgcccagctgtccaaacatgcttgaagtatgtggacaaagccatcaactgcgttgtagaggtgggaccgcatcctgctttgcagggacctgcgaaagattctattcttgccgctgtggatcgggagatcccatatactggcaccttgaaccgtggaaagagcagtacggtggctttttccgacgcccttagattcctttggtgtctgtttggctctgctgctgtgacgctcggagcgttccagcaaacaaattacccggatactccgactacaatgacccgcggtcttccaacatacccatggactcatgacagggggtactttgccgaatcaagactcatcaagacctttcacaaccacccgttgcccttccatgacttactaggaatccagacggcagatggagcaagggaggaatggggaccagtgaaatcgatcgatctcttcgatcttgaaatccacaaagctatcgccagccatgactccacaggcaccgagctccttacatccatgaccaaggtgtctgccctcgacaccgagtgggaagaaatcaccgctgacttctcagcctactccactataagcaaagacgctgccaaccttgggctgaactgctgcggtcgtgtgcgtgtgcttctaggagagggcgaggactcgccttcccacttctcacctagacttcccccactcggaaaactgaccgcagtagacgtggatagcttctacaagatcctgcgcgatgacttcggattcggatacgagggccccttccgcgcgctcacgaatatgtctcgcaaaaccggcttcgcaacaggcacagttcggtgcgagaggttcgacgactctgaaacgtctctgctcttccatcccggtatgctggatagtgccttgcagggtctgaacgctgcccatagcgccccaggagatgaccggctctggacaatcatcgactgcaatatcactgatccacgcgatacgcacatcactggagatgtggaggtcttctcggagggtttcagggagaagattatcgaggttgaggggctcaccttctccccgtttgcgagcgcaactgttgagaacgaccggtgtgtcttccaggagtcgtttctgtgccatgctaagccgaacgcggacgttatctttggtgatagacaggcaactcccgaggagagtaggaaggccctattcgctgagcgcgcggctccagagcagcgcgaggcacttccatggtatcggcaagctttgctgaagaacgctgagctgttattacaccttgtcaatgacgggaaacatccgtttgccccgcagaattgggtgagtgataccagagaggatatattcaagatgatggacagctatcccacgacagacgccgatttcaacctgaccaaggccgtcggcgaacatctacttctgccttcggtactgaatggagatacaagcatcctacaatacatgaccaaggataactaccttgagcggtactacgtagatgccattggattccagctgcttaacttcttgattgccggggtgatggaaccgctttgcttgaagtctccccgaatgaacttccttgaagtcggagccggaactggaggcgcgaccaaggcgatcctggagaagatcggttactcctatgcgtcttatacatataccgacatttccagtgccttctttgaccatgatgcgggccactttcaatcgcacgccagcaagatgattttcaaggccttggatatcacaaaggaccccgccggacaaggcttcatcccgcagagctatgatgttatcgttgcctccaatgttttgcacgcgaccgagtcattgagatccgccctagaacatacacgcaggctcttgcgtcctggtggttatcttgtgatggttgagataatccgtaacgacgtaatgcgccatggtctagtcatgggcggccttccaggctggtgggtcggtgagaacgatggccggtacggaggccctagtattactcttgatcaatggcataaaatgcttcgagaaaccggctttagtggtatcgagactaattcgccgatgagggacccagtcggcgtgcccggatcgattatcgtttctcgtgctgaaactgatctcgtcacccagttgaccagacctcttagctcaaagtttagtacagcaacagacaaaactccattactcattataggtggtatcagtccatttgtatcgccgttcagggaccagatctgtctcaccctgaggcggcatttcggagacatcattaaagttgagcagttcgcggatttgccaccgcttcctgagtgctaccatgtcctcagtctcacagagtgcgacgcaaacttgttcgaggacatggaggagtcggtcttcttgaatctgaagacagtgttaggctctgcactgagtgtactctggttgctccgggatcgtcgatctagtaatccgcatgccggcactacgcttggtcttttcagaacacttttttacgaagttccggggaccttgttgcagactctggatattgacgtcgtcaatatggacgactgctcagtcattgcagaatcaatgtgccagcttaggttccagtcggacatggcgagacgtggtgagacggatgagatccgctgggagtttgaaccggagcttgttctcaaggacggcgagctttatgtcccaagagttcgtccgcatgatgggcagaataatcgatacaactcctccaagcgattaattactcacaatgtggacgtgcacacgactcctttggctctagatctggtcgacggctcgtacatggtaagggagcagcacaccatagagaaggactcacccgaagtggctacagtcaatgtctcctgttcattcttgtcgtcaataaagactcccgtgggatatgtattcgttagcctcggagaaaatgtcaagactggcgaaaagacactttgcttcaccaaccataacgggtccatcgtcaaggtccacaaatcctggacaatatcccttggcgaggttgagccagatccagttgcagcatctctgctctcttggcatctgaacgggctaggcaggaaggctcttttcatgactttgagtccggaaatgtgcggccgaaactgggtgtaccttcatcctaacagcaccatgagagccatcgctgctaacttaccagccgacgtcaccctgtacgtcgacgcctctggagccggcgaatctccttcccaaagtctcggatccaagattgcgacctctctatcatcagtctgtaacaaggttaagatgtctagcctgactgcatcagaagcatcctttcttccgcacgatgcccctaaaaccatcacagatctattccgtcacgttgcttccttcgcttcctccttggtatccactcaagcaactccagagggtgcacctctcgatatcttaccgctcaaacgggatcaatatgttcctgtctctgttgagccggttacgcaacgtggtgatctgttccgtcctgatcgcacctactggctagctggtctgaccggagacactggacgatctctggcggacttcatgattgcccacaatgctcgcaatattgtgctaagcagccgtacgcccaccgtctacgaggactgggtagagtggcacaagtcaagaggtgtttcagtgaggtatttcggaggggatatcaccagctttcagtccgtgaaacagatccatgacgctatcaaggagtctatgccgcccattggcggcgttgcaaatggcgccatggtgctgcgagacagttccttcatgaaagtgagctttgacgatttccaagcggtcttaggtcccaaagttaaaggcaccatcaatattgaccggctcttctccgatcccaaccaactgctggactggttcattgggttcagttcagttgccggcactgtcggcaacccaggacaatcggggtacacagctggaagttgtttcatcaaggcactagtcgaccggcggcgtaagcaaggtctggctggatcagtcattgacatcactcgattggtggggctgggcttcatcgagcgtgaaggcgatggccgtctaacaaaggagcaccaagagcgtctaaccacgcggtcggggactattgcgatgagtgagaatgacctgcaccagttgtttgcggaggcgatcttggctgggcgaccggatctcgatcttaacccggagattattacaggtcttgcgcccatcactgttgagcagtccaaggatacatactggaagaccaatccgaggttgtcgctgttgatcagagaggcaggacagggtgatttaaaaggcagagacgggggcaacgcggctcctctgagacaattgttaggagacacaaagacaatgcaaaacgttgcgaatgtgctttcaggtgccctcaaaggaaagctgcaagcgttgaaattcctgtcggactctgacagcttgtacgacactacgcctctggtggacatgggtgtcgacagcctggtagctgtggaagtaaggtcttggttcttgaaggagctcacagttgacgtgccactcatgaagattctgggcggcgcatccatcacggatttagtagaggttgtcgtgcagaaggttccccgagagctattgagtaggcttgatcccgaagggcggcgtcaggacagcaatggcgatgttcctgctactgtgggtgacaatgactctgttgaaacagtgggatcaaagatgaatggcattaacagcgctcatgaaaatggttctagcggtgtcaatggtatcagtggtacttatacacctgatatggatagcactacagaccttaatggtactaatggggctgcagttatcaaggaaatgttagggcataaagccataaagggtgttgttccaatccttctaaatgcacaggaggttgcctaa

SEQ ID NO: 82 - DNA, 552 bp, Cladonia arbuscula
atgccatcctaccttatcactggtgccagccgtggtctagggcttgctttcactgctgagctgctcaggggtcacaataacatcgtaatcgcgacagcaagagacactgccagtgcaaaatacctacaagcccttaaaggaaagcacaacgacggccgtttccacattgtccagctagatgttgctagcgatgatagcattgacactgctgctaaggagatagcaaggcttctacctaatggactggaccatctcatcagcaatgccggtgttagctactctccacacgcgacttgggataacctggctattcgtaagtggtctggggttctccagcacgaaggcatcacgactgccctcattcatcccggatatgttggaagtacggaattgggtggccaggctctagattggattaacacgaatgcgcctcatgttgaacatctgacacccgcaaagagtgctgaagatgtcatcaaggtcctgaatcaacttaagaaggaggataatggcgcgtttctcaatattgatgggacaaagctgccgtggtaa

SEQ ID NO: 83 - DNA, 1800 bp, Cladonia arbuscula
atgttgatatcatcgaaaatagcagacagactggcgcggtttgcgcgtggtgcggtggatgttgactttattagcaccgttgccgaggctattcctgcatcttggcagaacgacaacgacgaaatgcattcacttgacagcaatacactgatttatgaaaggctccgtcgtgtcaacgaggcactgcctccaggaaccgatctaatggcgaaaccttggatgctgtgcgcagttcttgagcgagctgcaattgtcgagccgcggctattccacctgatgctgttgcattacgtcctcactcttgctccaatcgctcgatttggcgaccctgagcgagtgaaaagtttggtcacccagctcgagacgacgacggcgattggttgtccactaatcactgagtccggccgaagtaatagtcacctccacccacggacaacggcgacttatgatcctccatcgggtgggttcgtgctacacactcccgaccgtgaggcaataaagtgtccgtccatcactagtaatccgtacgttggcaaactggccaccgtattcgcgcagcttgtcgtctccaacgaggagcgtggtgtattcgtcttcgtcgtccctattcgggatgccgctgggacggtaactcctggagtccaagtcacgccacttgtgtcgtcatcagcgctagtcctcgactatggagctgtatctttcaaccaccttcatgttccgttcgacatgtggatgaacgatggggcgcgtataacgccaaatggtggttttgaggacccgattgggtcgacagggcgattagcccgcacaatgagcgtcggaaccctatcgtggctggctgctatctctctgtcagcagccattaccagagcagcagctaccgtcgccttgcgatactctgcaaaccatttcagcgcaaagcttctcgcatgcgaccagccactcataaaacggcgtaaccaatgtgatgcaatattcagtgcttatgctaccgcgttcacacttaccgcccttgccaatcacgccaaaggacaccgttttgaagacgatagagacgatgccagcaagcaatgtgccagccagcaatgggttccctgggtgtccgttgatcaagagttagcactacttaaggccgttgccagcaatcttgcagagcagacgattgatcgctgtaaaaagcactgcggagccaacgccgccgtcggcaccactcttttcggtgtctaccttggcattgcgcattcgtacgtaacggcgggtggggataacgaattgattatgcttgaggctgggaccctaacgaacggcacagcgaagccacatcggccaacaatggcacctgactcgtttccaacgacgctgcaaacttgccgtgagctagcccaacatgccgaagccgagctgcatcatcgcgtcagaacaacaatctcagctgtcgaggcatcaagtgatgaacaatatgacgctttgaacccccatcttgcactaatgttcgatgcgagcacagccaaagctgatcatatagtgctaaatttgctcgagaaggcaattgcatcggaaccagacgctcaagcccgccacgtgtttgataaacttgggacaatatatgccttgaactgggtggagcgccgagctagtacgctatttgaccttggactccttaagcaagggaccatcggatcaatccgcacgactcgggctgagctgtgtgaccagctccttgaccacatcccagaacttgtcgaaggtttctcacctccttcgaacttctttatcgactgtccacctgataggctctaa

SEQ ID NO: 84 - DNA, 918 bp, Cladonia arbuscula
atggggcagacgcttataattctcaatgatgcccaacttgcagtcgagatgttggacaagcgctccattaactattcttcccggccgcagcaagtttttgctggcgaaatggaagctgaggcctgtcacttcctactgcgtgtactggataagccagaaggcctcatagaccatattaaaaaacaggcgggatcgctaattctaaggatcgtctacgggtacattgcacaaccagatggaaatgacccccttgtggatttagttagtaaaaatatggatggcttttcacgtgccgttgttccaggggcattcattgtagacattctaccatggtccgagatgaccaagcggccttacgaatttgttaagtatcaaatagcccagggtgctgataacacatcattacttgcacgactgatacaggcaggggagaaaaactcggaagagatgttggcaaaccgctggtcagctacgtcgctctattctgggggttctgatacgacagtttcctccatgcaatgcttcttcctagccatgagcctgtttccagatatccagcacaaggctcaagacgaaatcgatcgtgaagtgggccaggatagactacccacgatgtcggatcgtgaaaggctgccgtacatcgaagcagtagtgcaggagacactacgttggcatccagtggcaccgatgggtcttccgcataccttggctgttttcacaattagcaagggagctacggatatgaaaaacgcgacgatgtctcatttcacgccggggattattagtcggccaaaacactttgaatgttccgtgaaactgcgatctcctcgccatgaaacccttatccggtcagctgaacagatttatccttgggaagacggccatggcagtgcactagagagagagtctcgtcactaa

SEQ ID NO: 85 - DNA, 1611 bp, Cladonia arbuscula
atggcagtcgactctcccactctagatgccctcgttataggcgcaggcttcgcaggcgtatacctgctaaagcgcctccgagatcgaggcttcaatgttaaaacagtcgacgtcgcctccgactatggcggcacgtggtactggaaccgataccccggtgcccgcgttgatagtaacatacctgtctacgagttctccgatcctttactctggaaggattggacatggaagcaacgcttccctggagatgaagaaattcgcagctacttttcctatgttgcagagaaatgggaccttcgaaaggacaccgagttcgatacctttatctcttcagccaaatggaacgagagcagtgctacttggaacgtatcaagcaatgatggcaagaaatacaatactaggtatctccttttgtgtacagggttctcagccaaacgctacacaccggattggaagggcattgagacgttcggcggcacatggcttcacactgcttcctggccaaagcaggaacccgacttgcttggaaagaaagtcgcgataattggcactggggcaactgctgtgcaggtcacgacggaggtttgcaagctcgctagcgaactggtcatcttccaacgcacaccctcgcttgcaatccccatgggacaggtcaactatgagaatggcgagcaagcattttcaaaggatgaatacccggccttttacaacgatcgcaaggaaatgtatggtggcgtcgccttcacattcatgaaccgcggggcgtttgaagacgatgccgagactagactcgctacctatgagaaactgtggaatctagggacgctagagtactggctggcaacgtacaaggacataatgataaacccagacgctaacaaggaggtatatgacttttggaagtcaaaagtgcgcgctagaatcaacaatgctgctcttcgcgagatcctggcgccagaggagcagccgtattactttggctgcaagcgtgtgcccctggaaaatggctactacgaggcctttaaccggccggaagtctccctcgtagatgtgaacagcacgcccattgtcgaaatttccaagaacggcatcatcacttcagaaaaagagtggcaatttgactacgtgatatgcgcgaccgggttcgactgcttcactggaggtctagcgcagattgacatccagggcaccgcaggcgacaggctatcggaaagttggaatgatggcggcatgaagacatatctcggtataactatctcgggattccctaatatgttcttcacgtacgggccacaagctccgacgccattgtccaacggaccgacgtgcattgagtaccagagcgacttcatcgtgcaagtcttgagcaatatgcaagacaaaggcctccatcgcatcgaagcaaatgcgtgcgcgcagaagaaatgggttgatgaaatggatgctatcgctgcggcgactttgtttccgcgaacaaagtcgtggtatttcggggacaatgttgccggcaagagaagggaatgcttcgtcttccttggcgggatcccggcatactataagagattgcaaaactgtgtgggggagggattatctgggtttaagatgtcataa

SEQ ID NO: 86 - DNA, 7590 bp, Cladonia arbuscula
atgaagactctagatagcagtgagaatggctcagttacctcattgtgcacaagctttgaggatgatgatgagccaaaggttaatatcattccgccaatggagcccattgcaattatcggcatgagctgccgactgccaggaagcgcacaggacccttctagcttttgggaaatgcttgcgtctggtcgatcagcctgggtaccagaccctggcaagcgttttaacatgcgggctttccaagacccatctcaaaataaggctgatactacaaatgcatgcggtgggcatttcctgaaagaagacgtcgctgcgtttgatgccagtttcttcgggattagccctctagaggccaaggccatggatccccagcaacgactcctactcgagattgcttacgagtcttttcagaatgcaggaattagcacagagtcactctggggttctgatacgggtgtgtttataggacagtggagttatgactatcacgagatccaaacgcgggataccgcctcccctcctctctacctaaccactggtactggtccagctatcctatccaaccgcgtctcgaaccaatttaatctacatgggccgagcttaactgtagatacgggatgttcatcgagcatggtagcattgcaccaagcagtatgcagcttacgtagaggagagacatcgatgtgctttgtcggtagcacaaatcttctcctcgatcctcaacgattcgtataccagagcaaaatgaatatgttttcaccagatggacgatctttctcatttgatgctcgtgccaatgggtacggtagaggcgaaggtattgcgggcctgatactcaaaccgttatccatagccaaacgagatggcaactatattcgagcagtcattcggaactcagtgttaaaccaggatggcagaacgcaaggaatcactgtacctaacgaagaagcacagcaacgcgcaattctgaaggcgtatgaagaagcgaatctggaactatttgctgactacgtcgaggcccatggcacaggaacaaaagttggcgatccaaaggaagcttccgccatcgctgccactttcacaaaacaaatgacgcatggccttcctctacctataggatctgtgaaagggaatattggacacacagaagcgacatccggccttgctgcaataatcaaagttgtcctcatgcttgaaaagggcatgattccaccgcaggccaactttaaaacggccaatcctgatctgcatcttcaagagcggcagctccgaattcctgtgaaactcgaaaaagtgccactccgtagggtatccgtaaataacttcggatacggtggaacaaattgtcatgttgtgatagacgcagcaccacctatatcttcatacgatacgcgcataaacgaatcatctcaaaattatcaccgcatatttttcgttagtgcagctagtgagaagtcatgtcagagtatatgcacccggttggcaaaatacattgtgaaggagcatcgagcttcaaacaacactgacacaatattatctcggcttgcatacactctcaacaaccagactattcacgctcatcgactagccctagttgcttccaacttggatgagcttatgtaccaactcagcgaggcttcaagtgcctcaattcctcgtcaagtgacccaaaggcagccacgcattgcactaatatttagtggccagggagcacagtacgcagagatgggcctgaagcttctggaaactcagaaactgtttgctcagtccatggagcgatctggccgatatttgaagactctgggaagttcatgggacttgctggaggagctccgtaagcccaccgagcaatcgtgcattaatgagccttctatatctcagcctgcttgcaccgcgattcaagtctctcttgttgaattgcttaatgaccttggcatcacagtatgtgcagtcctaggtcactctagtggggagattgcagccgcatttgctgctggagccctctcatttgaagatgcattgtctgcatcgtacttccgcggcaagcttgttgctgatgcgatcaaaaactccgccaatcctggtgctatgctcgccgtaggtgctgatccagccactgttaataagcgaatcaatgatattacgaatataaagggccgcatgaggattgcctgctacaacagccctgcaagtgtcactgtatctggtgacactgaggcaatcgggcaactccaagccatcatggacaaggagagctgtttcaatcgaaagttatcaacaaatggagctgcttatcactcgtatcagatggaacttgtatccaaggattatcaagctgcacttgacaggacattcacgtcgagacaagaccataggacaaatggcaaaaccactcgcatcttcagcagtgttacaggtgaagaggcggagaagagtacaatggccaattctagctactgggtgacaaacctactcaatccagtacttttctgccagggactagaggtcatgtctaaggaaacatacgaaggagaacatctcgatctcattgttgaagttggcccccactcacaactccgagggccagtgcaacaaactttgaagcagataaaagttagaggcataaatgatattgcctacacaaacacactaggtagaggagaagactctcggatctctatactcaaattcttggcaacacttaaggtcaaaggctctaatgtgagtctgaatcggatacacggatttacaaagactgaacacccaattcctctgattaatctcccaccctatccatttgatcatgaggtgacgtactggcacgagactcgagtatcccgcaattacagacaaagacagcatttgccacacgaactcttgggctctgtcgtgttgcataataatcgaatggagccgacatggcgccatttcttgagccctaaggagtcgccttggctgctcagacatttaatccaaggcgatgttgtatttccaggagccgggtttattgtaatggcagagcaagcagccaaacaacacatgctatcactcaaccttgattggaaaactaaaagtgtgaaattccgcaacatcagcatcaatcaggctcttgtgttttccaaggatggtccagatgtcgagattgtcctctcactacgtccggaagcgcggacggcgcgcgagtcatctaaagtctggaatgaattcagaatattcactgttacatctggcgacacgtggatggaacattgccggggactagtgcatgtaattggtgacgcagaatcgaatgatgctccattcgatgacggcaagagactggctgatattagcgagaagtgcactcacaaacataaccctcaaaagttctaccacctcagtcgtcagttagggatagattggaaagacccatttaataataccttaacaattcgcactggcaagactatggctgttacaactgctcggggaattttgaaggacgttgatcatggaggagttggtgatgtgattcacacaagcctgttggattcatgtttattccatggactttgtgcggtcaaaattttggaaggaggcgctacttcatcatttgttcccttctttatcgaagagcttgccatcttgaaccgactcatgcaatccagcgacctagtcagcacatctaccattggcagggacgggtctgggtttgatgtatatgtgcaagattcatccacatcaaattgtcctgtggtcatagaggctcatggtgtgcgaaccaaaactttgccaggagacaccggcctgagtgagtatatcaagaatatatcccacagccagaactgggtcacatttgtggacgcgtggacggcggagcatcgtgatcaaacttgcaaggtcaatgtaccccctggaagcgctacaagtttgaaccagattctcgatactctttcgcttcatttcgttcaaaagactctcaaagaggtttcccccgatgtagtttcagttgctcatcgtcgtcatttccttgaatggatgcaggaaaagataaaactcacgccagaaatctcccaattgccaagcattccaaagaaaatgctggaagattcgttagtacagggtgtccttcggttagggccagagttacagaggatccttaccaatgatcttgaccctctaactttactcactccagacaaccttctcggaagactatacaacacagagcgtgcctcacgatgtatatctcaaatggcagaatactgccatgcgctaggtcaacagtgtgctaagttgaagatcctcgaagttggtgctggtacagcctctgcaaccatgcccattttggaggcactgaatggtcgaggaaatcgttatgcctctaggtatgacttcactgatatttcacctggcttctttagtcgagctaaagatgtccttggagatcttggagatgccgttgaattcagtgtattggatgttgagcgtgacccaattgagcagggctttgaggagtccagttacgatctcattattgccagcaatgtcatacatgctactaaatctatctccaccgtcgttctcaacatgcgcaagctcctgaagcctggaggcaggtttatgcttatggaacttttggatccggatgcactatattacaacctgatattcggtgtttttgagggttggtgggctggatatgatgaaggtcgtcgcttgtctccgctgctcactaggtcccaatggacttctaagctccaactctgtggatttccagaaccggagctattgtttgaagactatccggaacagaacggtggtactcttggagtattcgtaagccgtgcacctgtagatgtggcaccaggtggtcggcggccgccaatccacgttatttcgaaaagactggaggaatacacatctggccttcaggatacacgcatcaacctcttgaagaaacagtttgccgattctgggctctcagtccacgatgtgtctacaacttcacctggcggaaatatatccatcataatgcccgatgtcgccaagtttatttgtaataagcctgatgaggccacttggcaaagtttcaagagttgggttctgaaagctcaagcggttatcctgatcgaatgtaccccaaccaagggtttggacgaatctagtcatgggatttggcttggatttgctcgatgcgtgcgaaaagagcgtccagatatacatattgtcacattggatcttgatgtgcaggccacaatgctggcagagcggcttattacggtacttccacagttgttgaagactatgccgaatagtacgagtccacagagtaaaatcgagttagaagacgagtttgccgagaaagatggacagctctttgtctcgcgccttgttcataacaacaaggcgacagattacatccactgggatagaaatcgtgcggagattgatacggtggactttgtcaattcagatgatacgttaattgctgaacttggaaccctcggactcatcggaagccttcgctggaagtacgacgaagcagagacatctcgtgtgtctccgaacgacgtcaagatagagctcagagcagcaagcattaactttaaagatgtccttattgctgcaggacaacttgagggactcacagaaatgcgcaacgactgcagtggtgtcgtcgtagatgttggctccaacatgcgagacaggtataaagtaggggaccgcgtttgcgccctctattctcgttcgtacacaaactatcccattgtccatggtgactgttgtcaagcgatacctgatgccatgtcctgggaagaagcggctgcaatccccgttgtttggacaactgtctattatgcgcttgttgatatggggcgactgttaaaaggagacagtattctcattcattcaggtgcaggagctgtaggtcaagctgctataatgctcgcacagcacatcggtgccactatctatgtgacagcgggtagtgatgctaaacatgacctgctgcatgacgagtacaagattccgcgtgagcatatattttccagccgaacaacctcgttctttagtggtatcaaggcgctcactggaggtcgcggcgttgatgtcgtcttgaactcgctcagtggtgagatgttccgtcactcgtgcaacatcgttgccccctttgggcgatttgtcgagattggtcgcaaagatctcatggatgacgcgaagatgccaatgagtttcctcctggacaatatttccttttcctacgttgacatggcattgatcatggacaagcaaaagccgctagcgagacgattgttgcatgatgtgatggatcttactgataatggcgcgattaagagtgtcacactatctgtaatgcctatttctgatattgaggatgctttccggaagattcaagctggtaagcacacaggcaagattgtacttcaagtcgcagaggaccagaaggtcaaggctgtcccaaaacttcctgaacaagcaaattttagacatgatgccacttacaccattgctggagggcttggtggccttgggcgggctattatacagtggatggtggagcggggtgcgaagcacattctttgcctatcacgatccggtggatgtgatgagcagagtcaggtattcctcaacgagatgcatgatagaggcgtcaaaatcattgcccacaaatgcaacattgcgttggaagatgaagtatctggcttagcacaagtagctgcgaaagcgggtttccctgctattcggggcgtgatacaatgcgccacggtggccaaggatgcgccttttgaagccatgaaggcttccgactggatcggatctttggcgcccaaggtggatggaacgctgaacttggaccgcgcctttggatcagatatggacttcttctttgtcatttcatcagccgttgcacttcacggcagcgggggactgtctaattatgccgcgggctgtagtttccaagatgcactggttagacgccgtgtagccgccggaatgccatccttctccatcaacgctggctcaattcaggaggtaggattcgtcagtgaaaatcccgtcgcggctgcagcacttcaacaacatggtttgggcgcgattagtgtcttggatttactcgccatgcttaactatgctatcatgcatccaccttctggcaatcctgcggatagcgtttgcgccgttggcttgttgcctaacaacgtggacaattctaacttgtctgcaaggcgatttgcattcctacagcgtcaaaacattgccggctcttctgtctcaaaggaaaacacgatgagtgaggtggctctcctgcatggcgcaatgcaccacgatgaagctattgcgatcgtactgcgcgctatactaaaacaactcagcaagctcactgcagtgccaatagagtcattcaatgcagctcagccaatacaaagctatggcgtcgactctctggtggcagtagagcttcgcaactggataggggtatacttgcaatcgaacctacctttgatggtgctgaggggcgcgagcagcattaatgagctcgcgagcataactgcaaaggagtcacggcttttaagtgtcagtggctaa

SEQ ID NO: 87 - DNA, 1449 bp, Cladonia arbuscula
atggatacgaaatctatcaggcctatgattccctttggggaggaagttattcagctctccgctctggatcaacaagcatcgcgacgatatgtcgataacttgctagtatttggactggaaggaaaagaaaaagtcaaggatgtagtccagcaactcgaacattctttgagaatcactctgtgtgaagttcctgactttgcggctacattggttcctgtgctagattccgaaaagaaagagttggaactatggattgggcctatgtctggtgttcaactgaggatactggatcatgatgataccgcagaagtcaatggaagaagcccacttgcaggccgaagcttcttgaagttggacgaagaaaggtttccctttggagcagaatgcagcgacttccttttttaccctcgtgcaggcttggaagtcgaatcttcacaggaacttccagcggtactcatacaaatcaatttagtccaaggagggctattcattggtgtttcctttcatcacaccctctgcgatggccacagtatggatttctttctgaacttatgggcaaaaaatacacttaattccaccattaagacagtcacaaatggtcgggtcatgcctctttatgaccctcaaggtagatggcaactaagtcatggttctctcaatgtggccattacgcaactaccagaatactacataaacccctctagaagggatcctcagcgacggacaacacatctattagatcatgaagaagctgttaaccttgttccaagcacctggtacatgagtaagatagctttgagttccctacgaaatgcactttgtgatgctggcatcaagcaaaccgctacccacttcacaaacagcgaggcagtttcggcgctcatttggaaacatttaagcctagctcgatcattggataagcttccaggagctaatacatcgttatttgccactcggattgatttcaggcctcggtcaaagccaattattcagaattcctacattggcaacatcaatgagcctcacgcaagggctcgcatgccactgagtgaagtgtgtgctccctcgacaccccagtcattagccatactcgcaaatttaatcagtgaagcagtcataaacttagacgacaaaatgatgcgtgactttatcggcctggtgcaggcagcaccagccgtcacagatgtgatactggacgctgatacttttcctggcccagacatgattgttaccgatacttctagtctacaaacactccaccagaactggggtcaggaactcggccagccgcttgcgatacgtacgggatttcgtgaaaagggggttgtgatattatccccgcaggatataagtggaggatttgaggcgcagctgaactgtactggccttgctctagaaaacctaaaagccgacaagttgtttacgaaatacgctacattcaggtgctaa

SEQ ID NO: 88 - DNA, 723 bp, Cladonia arbuscula
atgactccgttccacatcggctcactatgttacccataccaaactgtagatgttgttggcccactcgacgttctcagtagcgccggtcaagaatgttttggcatttgtcaaacatacagcccgacttttagcaaagaattagcttcccaggtccctgaatttgtctaccatcatattgggctcacattggacccagtatcactcacaggtggcttcgttgctacacctaccacaacggtcgaggactgcccagaactagactgtcttttattaggtggaccggccccccatttatatcaggtcgatcctagatacgccgattttatcagacgccatgttgccaagggaaaattgctgtgggccaactgcactggcgcatacgttgctgctagtgctggagtgcttgacggaaagagggctactgtcaatcacgttgagcttgcatgggttaagcagcattatccaaaggtaaactggactatggatgcaaaatgggttgtggacggtaatatttggactgcagctggtgcttctcggggcatggacatggctgcacactgggtcaaaaagacttatggtgaggagatattcaacttagcaactctgtctcttgacttcgaaccaaaagaggcggacggtgtcactgacactatagctaagcgttacgacgctgatggagtccagttacctacgcatgtattcgtgcattatccttcttattaa

SEQ ID NO: 89 - DNA, 930 bp, Cladonia arbuscula
atggttggcactgttgccgacaacttcagcagaagggttttacttcaggctaatattaatagcctcgacgacagggtggcgttaggcaacgataatttcgaggagatgacagactatttgctcaagatagagatactttccggcttgctcatcaattattccaatacacgaaccggtcttcaagcacagctgagcgttctagtgagtcttgaagttggcctagatgtgttgaatggcaagtttaaaaagacagtggccctcgttaatgagcctgctgtttatatatctgcgactatttccgccaatgagggccacaagcgcaagggagttgagatccgcacgggagttagtaatagtatctacgttgctgccttggataattggaactgtgtgattcgaagtggcgtcctttatgataaagggcttggttgtttgacccgtctctctcagcccctcgcaccaaaagacggacttccgcaggacggggcagggacgtctatcctcgtttctggtgcagacgggggtgtctacttggtgcccacaacagagacttacgatgtcagtgcaccatggggaacaattaatattaacactccaacagtaaatgtagacgtatttggccgcatcttgtcatttcatgaagcaacagaatctgaccccttgggccagattcctgtgggagtagcagacgtgaaagtctcaccgcccgagagggtgccggaaaaggatcgcgtggcaggactcaccacgcttgaggcttcaggagtgaagtataatatttacggcatcgccctgccaacgtctgaaaattttgttgagaatcactaccatcccatcagaatttactatcctactgtgtgccccactgtcaactgtctgccaatggaaaaaaagttcctgatgtctataattattgcatacgaactttaa

SEQ ID NO: 90 - DNA, 813 bp, Cladonia arbuscula
atggcttcaagaccaaacatcgttctaatccatggcctttggatgactccttgctgctgggacgactggatcacccacttcaacgctgctggttataccgtcatcgcgccaggctggcctggcatcgactctcgcacaccccaaaacatccgccttgaccccagtgcactagccggtcttactattcgccagattgtcgaccactacgcctccatcatcatcgccctccctacgccgcccatcataatgggtcactccttcggaggacttttcacgcagatcctgctctctcgtggccttggagttgcgggcgtaggcatttgtcccggccagccctctggtgtcattgcgcttaagccgtcgactattaaagccggctttggggttttgggtcacccatcgacctacaaggccgcagtacccatcaccgagagccagttccactacgcgtttgggaatcacctgagcgaggcggagtctaaggatctgtggaacaagtattcaatcccctcagccgggcacattttgtggcagggcttaggaggcgcgttcacttcaacgactaatgtcaagtcggatggacatgtgaactttgcgaaagaggatagggcgcctctattgctaattgggggtaccaaggacaacgttgtaccgcaggaggttgtaaaggcagaactgaagcattacaaaggcccggcgttagttgatatgaagatttttgaggggaggagccatggcatcgtgaatcaggaggggtgggaggaggttgctgatttcgctctgaaatgggtcgaggcgcacattggaatttaa

SEQ ID NO: 91 - DNA, 1947 bp, Cladonia arbuscula
atgaagtggtctgctggatggggttctgcttgtgacccttgcgcgaaggcaaagacgagatgtatccgctcccaggaggagaatggcgcaaaatgcaccaggtgtcagagcctcgacgtatcctgcacagagcaggctcgcaagcctaggaagaaaagacttcgccaaaatgcatcgactctgccagactttgcaattccacagctaggtcaccaggatggtcatttcggcagtaccactgagaaccatactcccccatcacgaactgttcatgccagtgtgacaacgaacgaggacgagcgcaatcatgcagcagagccagaggcaaatgtatacactgcacaagccaaggccgtagtcgctggagctttcagtgctcttacttcattaccggggtttcatccattccctaatccgacttgtacctgtttgtgggagatagatggcaagagtcacctggaagccatggaatccgacgaagttcttctctcgatatatcgtacaaggctgagtccccagtttccgtttgtcattattccggatggtgttaccgccgtcgagctgcaaaataaccgaccgttcctcgcaaaggcgatccggatggcggcctcgctacgtaatcgtcgatccatgtgggatcaaagcagattgatgatgcggcacatatccgaagcagtattcatgggcccagataggtccctggatctcctgcagggcattattgttttcctcggcttttatcattacttctgctttgcccatggacacttcaataatctcgcgcacctagcttccagcatgattgcagacatgaggctagatagaccacgagctaggccaccttcaagaaatatgcgcattctcgggcttgacccagaggagcccaaagcaatgtcaaatgatgagaagcgggccattcttgctgtctggtacataaattctagctctgcggtggcattcaacaaagtgaacgccccaaacaggcattttactcggcacatggagcgattcctccacgacttgcaaaatggacccgagtatgagacagacgacgtcgttgtacagcttgttcgtacacagcgcgtgaatgagatgatagctcaactccaccagagcgaccagtcagtcgatgttcgaccttcttcaaatatctggaccgccaacctcgacaacctcttatctgacttgaaagagctacggaattttgaggaaccgcagctcgtggatatagacaacttccgaaatgatgaggcaattgctgccttgaaacacacgccggactactttcgtacgacctcaaaaagccaaaaggatgcggcgcatactgcactgaggaattggttcgagggctggctgacaataccaatttgccatttcttctacatgccaatgtcaggatacttgcagctcacgaatgctaccacgatccttcttcgtcgatctaggctcattctgttgactcgccataggctgggagactcctactcgcctgagacggactctaacaatgcttcatctttcatgtgcaccaatgccagcaacagctcggatgacctgatgctagaccttctggagcgccttgcgtctcgatttgaacaggcaagaatcgaaatggccgcagctcattgtctcgaatgggccaatggcttcttagacttggtagcgtggaaacttcgggagaggaaagcgtgcatcgaaaagtgggtgaaaatcatcgccaccgaagcacagtccaacactctcagcagtgttcagatagagggaagtcaaagacccggccaagcgtgcggggatgaagacaagtcgactgcgacccaaaccgtagaagaagcagctctgtggttggatccacttgaagcaattcttctaggcggcgatgcttatgaggattggctatgcacgagtgcgcctttttctagggcaaatcctggctgcgaagcctcttaa

SEQ ID NO: 92 - DNA, 1176 bp, Cladonia arbuscula
atggctgattctaaagtttatcgcgcttccactatggctcccgtcaatattgccgttgttaagtattggggcaaaagagacgctaaattaaacttgcccactaactcttctctgtccgtcactttgtctcaggctgatttgagaactttgactacagcttcctgttcagcttcttttgttgatggcgattctttgactttgaatggagaagcttcagacatttctggcgctagaacacaagcagtttttagggaattgagatctaggcgtgctgctctagaatcttccgacccatcattaccaaagctgtctactctgccactcaaattagtttcagaaaataattttccaactgctgctggtttggcttcttctgccgccggtttggcagctttagtccaagctattgctaacttgtatgaattgcctgactctccagcttcattgtctattattgctaggcaaggttcaggttctgcatgtagatctttgtttggtgggtatgttgcttggagaatgggtgataaagcagatggttctgattcacaagctgaattagttgccccagcttctcattggccatctatgagagctttaatattggttgctaatccagacagaaaggatgtttcatctacttccggcatgcaacagactgtcgctacttctggtttgtttcaagagaggattactaaaattgttccagctaatatgactggtatggaggaagcgatccaagcccgtgattttgctaaattcgccgaaattaccatgagggactcaaactctttccatgcttgctgcgccgatacttatccacccattttctatatgaaagatgttagcaggtctgctattagagctgtcgagtctattaacgctcaagctggcaaaactattgccgcctatacttttgatgctggtccaaattgcgtcgtttattatcaagaagaagatgctccaactgtattgggtgcttttgcaccagctgttcaagctaaatctggttggaaagatggtttggtttctggttctacctctgttaaactagctgaaggtttgaccgctgctttgtcagaaggcttgaaatctgttattttgacttcagtcggcgagggtccaattagaactgatgaattcttggttgcagaagatggacaaaccgttaaaagataa

SEQ ID NO: 93 - DNA, 9399 bp, Cladonia arbuscula
atgccaatttctgaacaagatcatcaaactggtgcttctggtcagggtcctccatgtccagatcctattgctattgttggtatgggttgtaggtggccaggtggtgtgagaaatccagctgaattgtgggagttgttaagagaaaaacgtgatggctgggctgaatttacttctgatagaattaatattgatggcttctatcaccccaatggtcaaaggccaggatcaatgtttaccaaggctggacatatgttgcaagaagatccccgtttgtttgatcattctttttttggtatatccgctactgaagctacttctatggatccgtcccaaagaaaattgttggaagtcacttacgatgctgtcgattctgctggtgttccatttgacaggtttttcggttctcgcactggtgtgtttgttggcaattttaataatgatcatcagttgatgcaatttagggatccagatcatactctaccatacgttgtcaccggtggcggtccaactattttgtccaatcgtatcaattattgttttaatttgcagggtccatctctcatggttgataccggttgttctgcatccatgtatgctctgcacttggctattttatctttgcacaatggtgattgtgatgccgcaattgttgctggtggtaatttggtcttgggaccagatggtcaagtttttacaactaaattgggtgctttatctccaacttccaggtgtcatacttttgatgctgctgctgatggttattccagagctgaaggttttggtgctttgtatttgaaaaaattgtctgatgctagagcttctggagatccaattagggctgtcgttagaggtacttcattcaacgctaatggaaaaacaggtggtattagccatccatcagtcgaaggtcaagaagctgttattagacaagcttataaaactgctggtttggatccacatttgactggttattttgagtgtcatggtactggtactccagttggtgaccctattgaagtttctgctgtcggtaaagtttttgcttcaggtagaagagatgaaccattgttgattggttccattaaaccaaacctaggtcattcagaaccagcttctgctatgtctcagattatgaaagccgttttgagcatggagcatggcgaaataccagctactattggaattgagaaattcaatccgaacatagattttgaaggtgctgctgttagggttgttactgaaatgactccatggccatctcacttgttgagaagagtctctataaattcttttggttatggtggtgcaaacgctcattgtattcttgatcatccatctgtattgttgccaggctacgaattgcatggttatccattggctaggtcttctagaacaaatggtttgaggttgctgaatactaatactcatatcaatggtaataccaaccgcgttatgggtggtcatacgaattctcacggtaacattgctaccgatggacaagttaacccatctgtccaaaaagatattaccactgccttggatcatcactctattggtactgcacatgctgatatcggcaaagatgaaaatccatatactaatggtttcactgacgttcatacttctcgcattccaaatggtgctaatggtcatagtttctctccatgcagcatggaatttcctcagttgggatctttggaacaaactgaaagagcaggttctagaccatttattttgctaccattttctgctcatgacgacaatgctttgaaagcagctgttgaaactactccacagttgttgagggactttaacctttctgatttgttgtttaccttaggttccaggaaatcccgctttccaagacgtgctttttcaattgttaaaccacaatctggtaaagctgctccagatgctgattcagttaattatggtaggactccaaactccccaattcgcagaattggttttgtctttactggtcaaggtgctcaatggccagaaatgggtgctaggttgattgatgaatatgccgtttttggtcaatgtctaaggtttttggattctgttctggctagattgcaacaaagaccttcttggactattgttcaggccttgaagcaaccagctgcaacttctcaaattcatgatccagctttttctcaaactttgtgtactgctttgcaaattgctttggttactctactacggcaatggggtattgaaccatctgttactgttggtcattcttctggtgaaatagccgctgcttatgctgcaggtagattgttagcatccgaagctattgtcttggcttattttaggggcttggttgtcgctactaataggcaaaaaggcttgatggttgccgttggtttaggttcagaagaaactttgccatatttagaatcttatggttccgatgttagaattgctgcagttaactctcctgcttccactactgtttctggtaagccagctgctattcaagaattgtcaagaaaactaactgaacagggcgttttcaatcgcatattgaagaccggtgataatgcctatcattctcatcatatgctcccactgggtgaatcatacgagcaattgtctattaaaggtttgcaagatgttgcttctgcctctcaaaatgaaccacgtagaccatctattgcttggattagctctgttacaccagaaaaacaagttcatacagctactccagcttactggcgccaaaatttagagtctccagttttgttttctgaagccgtccaagtcttggcaagagaagaaagaacacaattattaattgaaattgggccccatccagcgttgtcatctccattgaatcaaattaggtccagattggaaaataccggacattctctaccaccttgtttgggttctttacaaaggggtgaacacgatgttgtttctatgttgaatttggctggtaggttgtttatttctgacgccccaattgatttggttgctgttaatgcttccgaagaattaagagacggtagaattcatctgttgcatggacatgcctgtatcgatatgccccagtataaatttacgtatcccgaaaatcccgtctattttgaaaaccgttattctaaggaattcaggatgagaaagtaccccagacatgatttgttgggtgctaggcagccaggttgttctaggactcatccttcatggagaaatgttttgagactaaaagatttgccatggttggatgatcataaattgatcccacatgctgttgttccaggtgctgcatatattgctatggcagttgaagctgctagacagttgcattttgatgccgatgatgctttaccagtcaaatcattcaaactgaggaatgtcgctattaattctaccttgagggttcaagatggtgacttcggtactgaaactgtcctgaacatgaaacgcacttccttaaccaattctaacatcttgtctatttggtacgaattttctatcggctctatggagccagattctggtatttggactgaacattgtggcggttcaatttccattgagacacaatatactactattagggaagaaaataggttgcaagccgacccaagatctaggtctttggatattaggagatggtatgacaagtttggtcaaattggcttgggttatggtcccacttttcaaggtttgtctaaactgcaagcttatccaggtactaatattgctgctgctgatgttgctctaaataccactgctggtaatgttcaaggtggtgaatccgattatgtcttgcatccagctgctttagataattgttttcaattggccctaatttcctgtcatgccggtcaagttgaaaatgtcaaatgtggctttgtcccagttggtgttgatgaaatgactatttggccatctagaactatggaaaggcaagctcatggtttggcttccgctaaacaattgggtgttaggtccttatatgctcgtactcagttgtattctgcttcaggttatccattgctagatattggtgaattgaagtgtgttgcttacgaaggtattgcagataaagctgttgctgctacttcttttccaagagaaccatattggaggccagtttcaagagtcgatgttgatactttaacccaggatactgtcaaagctatgttcgctcccggttctatttctttgccaaagatggaaatgttcgacaaattttgctcttacatactagccaatattaaagccggtctaggtttggacgctgacgctgttaaagaaggagaaggtcatggcgaatttgtttcttgggtttgttctactgcttcttctccagcttgtagacaagctttggaattggaagcagttaaaaggattcaagcaattgatgctatggttgcctctctgtctgatgttccagaagcccagtgtattaagttactacatgacaatttgtccggtattctaaatggtaatacgtcctctattaaggtcctactggagggtaatctgctggatgagttgtacacttccggtatatctaagctgggtggttattctcagatgcaaaagttggtttctttgttggctcacaaaaatccacgcatgagaattttagaattaggtgctggtatcggtggtgctaccgcttgtgttttggatactttgggttctaaatccacttctagaatgtttgatcaattagtcttcactgattctgctgattggtgtttggccgaagctcaaacgaagttctctggccataatggtgttacatttcaatttttggatgttcaaaaagacccagtctcccagggcttcgatgaaaggtgttttgatttgattattgactctggttccctatctcaagctgaagatatgagaaaagctttagcccacgttcagaaattgctaaagccagatggtaggttattgttgcaagaaattactaggccaagattgggtttcgacattttgtcaaggacattgacaggcaaatggaatggcaatgagacttttagggatgaagagacttggtccaaattgttattgcaatctggtttttctggagttgatgtctctttgagggattatgctagagaacaggctatgtccactgtcatgttgacttctactacttcagctaccaaacaatctgacaagaatactattgctcttcaaagggatgtttacttggtttatagggagtatccaccacccctagctagatccattgacttgattttgtcttctcagggttgtaatacgatttacaagtccttgatgtcccattctgatatcccaagaggctcccacatcatttccttgattgatatcgaaaattctactttgttcaccagaggtgaaggctatttttctgccatgcaatctatgattactcaagccgccttggtcatttgggttgcttctgctaatgatatttctggtggtaattctcactctgctgctatgagaggtattttgagatcaatagctacccagcatttgttgttgaaggtcgcttttttcgagttagatgatacccatattactcgaagaagaactgtcgctgaactgatttccaggaaactatccgaattgcataattccactgatgctgataaggcaattgacagagaatgtagagttcaagacggtgtctcctacattgaaagatttttgccagatgactctttgaacgaacaatttcgcttgaggcaaggcttacaagatgaaattcaagaagtttctgttgccggtttgtcaccagttaaagctcaatataagcaaccaggtttgctttcatccttgtactttgcaaacgatgtttccttcttggaacctctaaaggatgattgggtcgaagttaaagtcgaagccattggtttgaatactaaggatattgcagttgtcactggcaaattcgactgggattatttttcatcagaagctgccggtgttgttactagagctggttctacagctactaatttcaaacaaggtgacagagtttttggtatgatgtttggcaacatgggtaattatgttaggtgtccatcctatggtgtcgctaagattcctgatggtgaaacttttgttggtgcttcctctatgccagttgtttatttggctgctgtttatgctttgcaacatttggctaggttggaagaaggtgaatcaattttgattcaacatgcgactggtggtttgggtatggctgttatgaggattgctcgtcatatgggtgcaaaaatttatgctactgtcggttcaggtgaaaaaagaaaattgttgactgaagaatttggtgtcttggattctcatatttttaactctagggacctaggtgctattgattctattatgaacgccaccgacggccatggaattgatgttatattgggctctgcttctggtgatattatgcatgaaacttggagatgtattgctccattgggtcgctatattgatgtcggcagagttgatgttttgggcgctgggaaattgggtttggaagtcttcaagaaaaatgctactttttcttcctttgatatcggttacctgtactggcagaaaccggctctgttgctgaagttgactcaaaaggttatggacttgtggactaagggtgttattggcccaattgaaaggatcactaaatttgatatttccaggctggaaggcgctctatcacatttctccaaaggtgttcatgtgggcaaaattgtcgtcaccttggataacccaaattctaaattgaaggttggtcaactgccacagcgcctgtccgttatttctaatactgttactcaagttgctaagtccgctgacaggaaacattttgattccaattctgcttatattttggttggtgccttgggcggtgttggtagatctctagctgtttggatggctcaaagaggtgctagacatttggtttttatatctagatcaggtactgatagggctgaagcagaacagaccatatcagaattgacttccatgggtgttgagccacaagttttgagatgttctgtcactgatagagaggctattacttctgctgttgccgaagtatcatctgttagaccagttaaaggtgtcattcacgccgctatggttgaaggagatgccttttttgaaaagacttcttactccaaaatccatcgcgtcctggacccaaaagttgctggctctattaatttgcatcatgctaccaaacatttggacttggacttctttgttatgacttcttctatcgttggtcccatcggtactccatcacaaggtgcttacgttgctgctaatgcttttcaagatgctttcgctagatttagggtttctcaaggtttgcctgctactgctttgggtttaggactcattttggaaataggttctgtctcagattctatcggtttccaagatatgctgcaaagaaacgctacctacggcatttcagagacggaattactacagttgtttgaaggtgcattgtgtcagtcttctttgagagaagctaataattccgctctgtctagattggatccaggttgtgctgcacaaatttcattgggatttgaaccagataggtttgttccaagagtccatgatggtagaatggcagactttatttggcatggcaataccaggtttcaagctgtcgttcaatctatttctattagggctcaagaacaagcttcatctgccggtgcagctactggtagagcttcctctatggcagctaaactaaggaatgctagttccttggctgacaaaagagctgttgcaagagatgctgttgttgaaagaattgccaaattggtttccatcgaagctgatgatatcgataccggtaagccaatgaccaggtacggcgttgattctttagtcgcttcagaaatgagaaattggatcattaaatcttttggcatcgacatcaccttgctgaccctactgagcaaggccaccaaaattgacgatgttatttccgcttctgtcgctggtaggttgttttttatcttgggcgcattgtttttggcacaacaatacaatgagattcaatccctggttgcttctcgctccagaagaggtatttttcagtctgctttgcaagatactttacatgccgaaatcaacggctataatcctgccgctacagaaacctgtagagtcatttctaggagagctattggtcatacatcttctactgctccaccaagattgaaaatggctgattctaaagtttatcgcgcttccactatggctcccgtcaatattgccgttgttaagtattggggcaaaagagacgctaaattaaacttgcccactaactcttctctgtccgtcactttgtctcaggctgatttgagaactttgactacagcttcctgttcagcttcttttgttgatggcgattctttgactttgaatggagaagcttcagacatttctggcgctagaacacaagcagtttttagggaattgagatctaggcgtgctgctctagaatcttccgacccatcattaccaaagctgtctactctgccactcaaattagtttcagaaaataattttccaactgctgctggtttggcttcttctgccgccggtttggcagctttagtccaagctattgctaacttgtatgaattgcctgactctccagcttcattgtctattattgctaggcaaggttcaggttctgcatgtagatctttgtttggtgggtatgttgcttggagaatgggtgataaagcagatggttctgattcacaagctgaattagttgccccagcttctcattggccatctatgagagctttaatattggttgctaatccagacagaaaggatgtttcatctacttccggcatgcaacagactgtcgctacttctggtttgtttcaagagaggattactaaaattgttccagctaatatgactggtatggaggaagcgatccaagcccgtgattttgctaaattcgccgaaattaccatgagggactcaaactctttccatgcttgctgcgccgatacttatccacccattttctatatgaaagatgttagcaggtctgctattagagctgtcgagtctattaacgctcaagctggcaaaactattgccgcctatacttttgatgctggtccaaattgcgtcgtttattatcaagaagaagatgctccaactgtattgggtgcttttgcaccagctgttcaagctaaatctggttggaaagatggtttggtttctggttctacctctgttaaactagctgaaggtttgaccgctgctttgtcagaaggcttgaaatctgttattttgacttcagtcggcgagggtccaattagaactgatgaattcttggttgcagaagatggacaaaccgttaaaagatga

SEQ ID NO: 94 - DNA, 1308 bp, Cladonia arbuscula
atgacgattaaaacaactcaaatagtgggtgagagagactctgataagtctctcattctgcagaaggcccgcgaggccctcaagcaaacagagagactcgttcggcaccttgaggctcacggacaccccgagccaaacttcacaacaggctctccagctcatcctgccggccatgactttgacgcaatccgcgtgagccttacggatgccgctcaagacctcatcctcctggctaatggccccatgcagtggctccgtacctttttctgcatccatcatgacctgagcgcgtggcaaaccgccctccgcttcaagtacttctccatcgtgccgctcgacaggccaatcgctttaagagacattgctgcgcaggcgaagatggacgagggccgcacgaggcagatcatcaagatgctagccacgcagcgttgcttccaagagacagaggaggatgtcttcgagcacactgccctgtccgcctttgtggcccgcaacaaggatatcgaggctgtcattgcctttcaagccgatgaaatgtttgaggctgcgtccgtgactgccacgtcaattgaaaaggctcctttcacgtcggatgccgcccatagcgccttcaatctccggttcggtacgagtccttatcagtggtactcggagaacccggaacggggtgctcgctttgcctctgccatggctggcctgggacagatgaatagagatcgagctgagcttcgtgatcgctttccttgggccagtcttgggagccagactgttgtagatgtcggtggtggcagtgggcatatatcgatatacttggcaacgcaatttcccaacctcgattttatcgtccaggatgtcaatcccggcatgttagcccagggtccaaagcggccagaattcacacaggtagagaagcgcgtgtcctttatgcagcacgacttcctgcaaccgcagcccgtcgcggatgcaggactctacttcatccgccaggtcctgcacaattacccagacgacgtctgcgtcaagatcctcagttcatttgtgtctgtcttggagaaggccagccctgagacgagcctcgtcatcaatgacatgattatgccgccggcaaacacagagctcaaagcagaggagcaccatttgcgtcaggtggatattgccatgctgaatgggtatgctgccaagcagcgcacggtgaaggagtttacgcacattctgaaggaggcggatgagcgattcgaggtcgtcaaggttcatggcaagggcatcatgggactgctggaggtcaagctggtgcaaaagtcagcatga

SEQ ID NO: 95 - DNA, 1443 bp, Cladonia arbuscula
atgggatgggccacctctgcggcacagcagcgaccttttactgcactgacgctggccgtcattttccttggtgctgcttcaatagttgcggcagactttctgtccaacttccccaagcgctactatcccatcgccggcgtcaacaagggacagcatatatttcacgagatacaaaaccgactctactggttcaagtgtggtcctctcttgatacacgaagcgtacgaaaagaaccacaacgccatttacgaattgccatcgctggaccgcacatcaattgttctccccgctcgcttcctcaaggaagtcaaagagcttccgtatagtattgctagcaattcacatgccacatcagacttcttcgtgggaacatggacgacgttggactatgacatattcggccacgccaatctggaagctatccgatcccagttcattaccaagattggctggcaagttgccccggccctggatgagttgacctatgcatttccccagcaattcgagagctacccagattggactcctatcgcaccacagcccaaggtactgcagcttgtcgcgcaaatggtcgctcgcactgtcgtcggccctgacatttgtcgaaacccggagtgggtagcttctgtcatcgactacgcgcaaaacgtcttcatggccgccatttgcttcaagctcgtgcccaacttcctcagggggccgcttgcagccttgacgccatacatgtaccgcatatacaagtgtcggcgcaagatcttcaagattgtctcgcccgccatcaatcatgcgctcttcactcgccgacagcgtcccgacgaatgggcgacaaaggttaaaacggagcagatgaacacaattgactggctggtaaagctgtctcccccgactgaggcgactccagagatgattgcccaccgcctgacgggcgtaagtttcggcgcctctcacacaacgtcaaatcacgtcaccaactgtatcctggatctagccagcgatttcaagcggtgggcgcctcctctgagggaagagattgagagtgtgctggggccgaaccctactacaattacgaacgcgaacttgtccaagatgtggaagctggacagcttcatgaaggagacgcagcggttccaccctccatcgaagctctccgtcaatcgaaaaattctacagccctttagtctctcctccggcgaacctctaccacgagatgcccacatctccttccctggcgtacctatgtcaatgtcagaggagtacttccaggatgccagatcctttgacggattccgcttcgagcgcatgcgccacgacacgtcgatcgatcacagtggcctacaattcacctcgtcctacgaggggagtctgcactttggtcatgggagacacatgtgccccggacgcttcatgggcagcctcatgagcaagctgctgattattgaatga

SEQ ID NO: 96 - DNA, 1464 bp, Cladonia arbuscula
atgaacaatgcttgctgtctcgcacgactaccagcgcggccgagctcacgagcctgtggatgggccatcttgagaagcatcgcaggacttcgatgcacaccaactcgcagcattggacgagcagtaccagttacggcatcaatcgagttccggaaacagacgtggaaatcgcgaccatttcacacgcaacatttctctaggaaagcacaagtagaatcagagtctggccacgagcgggagagtacgagtcgacttgcgcgcgcacaatccgctcagaaaaaggccgatgatcgaccttggcagcgggagagcagcaatgccttgccggaatctacttctccagatccatctggaggagatgaaaccaaaggacggctcctcacgacgccgacgcggttgctgaagcttatcctgccgatacccttccaccccgatcaggaattcatcaacgaggacaaggacgaggcggcgcagaaacgaaacagacccccggtcgagcctcttgcgctgctcgtccacccacagcaaccactgtcatacctcgaaaggctgattcaggccgaaataccaccaatcaaggccgacggacgagagaggctgccagacatcttattccacgcagaagccgaccgtgaggagactcatgggaggccacgagatgacaggaccaacgtcgcgtcgtattccgggctcggtagagagggacctagtaggcatcatagcgaagccagctgggtgcgatggagtagcagcaccgaagtgggcgacttcatccgggatgcagcacggggacgtgagttttcaatcgccatcgagggcctggacaccgagcttagggtagctgtgcctagcttcaaagaccggacctactacatgcggacgcgattgcggcgaatgtcccaccagatcgatcaaatgtcacgtatcaagagagaatgcgacctgctggcgcacaagggagcgcatcggctcgccaaaggtggatttgcggctcttgccagctggtgggccgtggtctactacgtaacgtttcacacggaaatgggctgggatctcgtcgagccggtaacgtacctggctgggctgactaccatcatgggcggttacctgtggttcctgtttatcagcaaggacctcagttacaaggcggccatgaacattaccgtgtcaaagcgccagaacgtgctgtaccaggagcgcgggttcgacccaagcaagtgggagcacatcgtgcacgaagcgaacggcctgagaaaggagatcaagatcgtggctagcgagtacgacgttgactgggatgaggcgaaggatctagggggcgaggaggtcaagaaggtgctggaacgcgagaagaggagtaaggatgatggcaaaggacggaagggcgaggacgaagaaggggagcagggggagcaaggggaggaagagaaacctgagccggaaaccaagtccaagaaggaataa

SEQ ID NO: 97 - DNA, 1635 bp, Cladonia arbuscula
atgccgcctcaagtcatccatctgccagatgggcagacctttaccgtgacgccggtctttggcggagtcggattcaagagtcacgagctgacgacgcaccaaaatgcatttcccattgggtggacgacggtgctgcacacagaagacgacccgaagccctccgacgacagcaagttcagttctcccttcagctctaccaacgaccttggccaagatggtggcagtggaggcgatggcgacggagacgacgatctatccttaggccgtcccagagccaagcgacgcacgcacccattcacgaagccgacactgcaaaacgacaccctcttcatctcctccatctccaaccccgccaacagcgagttcaagcccgccgccagtcccacgcggcagatcgccatgatgatgtggatcaccctgtattggtactttcatcaacctgaacccagtcggacgatgtatacggccgcgtcgagcgacacgcctcgtgctgcaaagcccaatggagagtggaagattgctatcaagcgcgatggggtgctgcgcggccgtaacctgataccgaagctggagcgcatggggcttattgcctcagaagacacggctgtaggtgtcagccttgacgacagcggggacggctgggaccgcatgtttgctagcaagcgaatgttttggcagacgcccggcagactgttccttttcactctcgctccgaaccggtcgttatcgtcattccctggatcgccagcaggcagcaggccgggttcgccagttcgaggagagtcaccgcatggattctatcgccaaacccattcgcactcgccgagctcgcattcgcgcatcgattcggacctccctggtgcgcccatgccaacgaccttggttaccagtccgagttttcccatcggccccttcttctcgacgtcacatctcccgacgtactacccaccaccgccgcttcagtacaagctgacgggtggcgtgcgacatcctctacgaccgaagccacccaggatgggagaggtcttttattcacgattcgtaccaagcgtgggacaatacttgtccttccgggttgcgtcctcatcgcccaagcccgtcccgtacctaggtcccaccggcccaaaatctccagagcgccaacacttgtgtactctggccgacacctctctcttgcaaatgtggtttgccaatccgcgcatcagcgagttttggggcaactatacgcccaccttcctctcagatgctctacgcctaaatcactcgtttcctgtcattgggatgtgggacggcgtgccctttggctactttgagatctactgggtcaaggaagacatcctcgggcaacacattggacacgacgccaacgactgggaccggggattacacgtcatgattggtgaagagtggtcgcgtgggcgggttccgacgtggctgactggactgacacattggtgtcttgaggccgactttcgcaccatgaacgtgtgcctggagccgcgagtggacaatgcgaggatgctgcggcatttggacgcccttgggtttgcaaaggaccgccaggtttcgtttcatcacaagcaagcgtggtttatgaggctgcgccgagattcgtgggatggaccagcgttatga

SEQ ID NO: 98 - DNA, 858 bp, Schizophyllum commune
atgtctttgagcctacttcgtcgtgccgcgcatgatctgcatactctgtatctcttcacgaggtccgacttcaaatccatcctttttcctatctccgtcttcgccctcttcacggttgcatacgatgtatcgctgacgaccacaagggtcttgtcgacggtgttctgggtttggattcacctcctccagttctgcgtttcgaatcagacgctctcatccgacgaggacgcgcaaaacaagccttggagaccactccccgcgcagaggatagctcttcgtgatgcactcgtgctgcgatgggcattgctgcccatctgcgcgctcatctgcgtcgcctacgatctcaaattcatcgcgttatggttccccttcggcgtcattatgcacaatgagctgaagctcgactcacactggctcacgcggaatgtgctcaacgcacttgcgtactgcaccttcgacatcggtgcgacttctgtggcccgtggcgagtaccacggcttcgcttcaaagaaggccttcaacacccacatcttaaccttcctaatcgtcctcacgacggtccaggctcaggactttcgagacgaagagggcgaccgcaccgcaggccgacgcaccatccccatcgtcttcccgcggttcggacgccccaccatgcttcttgccatgatattctggtccatttacatcgccacgcagtgcgagcttccggccctccttgcctcggccatcctggcgggcggcgccttcgttggagtgaggttctacctcttgacagacgccgcctccgaccgcaagtcgtacctgtactacaacatatggctcgccaccgtgcggattgcgcctttcatccgcgtttga

SEQ ID NO: 99 - DNA, 1515 bp, Schizophyllum commune
atggctccctcccccatcgtcctcgccgccgcctgcgtcgcgctccccgtcttctgggtcttccacactcgctcgccgctccccgcgctcccctaccgcctcccctggatcggcaacctcctccagctcatcccctggcgcaacaacgtcgtcggctggctagagcacatccaggagcagtacggcgagatctgcgagctctatctcccactgtggggcagaatcctggtcatcggccacccggcgtggctgcaacatgtgaagcagggcgacacggataggtacagccgggggcctatcgcgattggcgtgttcaaggagtttcctgggccgaagacgcctgttgcgagtgagggggcggagtggaggaaggcgaggaaggtcatggcgcctatcttctcggtcaagtcgttcaccaatcacatcagtcattcgatgcgcgacatctcatcggtgacccgccagttattggacaacgtcgctaagcaggacggccttgtcgattggaatgatctctgtggcaagatcgcccttgagatcttttgcatgtcatgccttagcatcaagacgaacaagctgcgcaccgacccggaatgtctgaaggaggacgactacctccgtgactgcttgattgcggtcagccagacgtcggtgaagcgcctcttcaaccccttttacaagtggacggagctgctctccggcgaaggccgcaaattcgagacgtcccgtgcccatattcgtgccctcgtcgacgacgtcgtcgccaagcggcgctcctcagaagacaccgacggcgtcacccacggcgactacctctcgcagatcatcaacgaccccgagtacgacaacgcggagctcctgcgcaacacgctcgtcgtgctccttttcgctagcggtgacaacacgcgcaacagcctgacgtggtcgatgcatgcgctgctgcagcacccggagtggatggagaagatgcgggaggaggcagtgaggaatgggcagctgtcggcggatttgatgattgagtatgcacatctgaatcgcttccctattgctatggcagtcttctacgagactgtgcgtctgtggcctggcctgccgaagaatgcccgccttgctgtcaacgacgatgtcctgcctgcgattccggagcacgatttgcccgctgtcaaggtcaacaagggcgactatgttctctggtctgactttgtcatgatgcgcaaccccaaggtctggggccctaacgccgatgtctttgacccctcgcgccacctcaaggatggtgtcttctacaagcctggtcagcccgacttcaatggcttcggatcaggcccgcgcctctgcccggccgcgcagctcgcagcctatgagtttgtcgcgacgtgggcgagccttctgcctcacttcaacttcgaggcggcgtacaaggaggaaccgaagagggacgaggctttcaccatgtcggttgctggccagcttccggtgaagattagcgcgagggatgctgctgtgttcaactag

SEQ ID NO: 100 - DNA, 1149 bp, Schizophyllum commune
atgtcgtggcaaggcctcctctcctcgctgaagaacctgctctcgtacgcgatgttggcgactgtggcacccctggcgcctaaggcgcaccagccggctttgcctgcgcttccgaagctctcgccggaggaggagaagctggagctgcaggacaagcttgggaggtatattcaggggatgcgggagacgttcattcgggacctctcgacgtccaacgagctcctgacggaggtctcgcaatactatgcgaagcggccctcgaagctcatgcgccctcgcttgatccttctgactgcacttgctgtgaatgcgagcgtcggcgaacgcgatgcccttccccagcaggtccgcctcgccgagatcgtcgagatgatccacgttgtctctctcctgcacgacgatgtcatcgacgaatccgacacgcgtcgcggcgacctgtccgcgccctccaagtttggtaacaagaacagcatcctcgccggcgacttcgtcctcgggcgtgccatgtctctcatcgccgcgctcgagaactttgacgccatgcgcgagattgcgggtgtggtcaccacgctggtcgagggcgagatcatacaggcagaggattccatcgcgctcggtgagaaggcgaaggtggggcaggcggcggaccagtggggctcgtatatggaacgcatcttcttgaagacgggcagcctatttgcgcgcgctttgaggagcacggcgatgctctctggcttgccgagcgacgacgagcgggtgcttgcggtgggagactatggcacggagctaggtcttgcgttccagatcatcgacgatgcgttggatttcaaggagacctctgccgatagtgcgggaaagcccacgggtgctgtcgacctgagcctcggactcatcaccgcacctgtcttctacgcgctcgaggaacggcctgatgagctcgcaccgtatgtctcgcggaagtgttctgaacctggcgatacagcggaggtcgtccgcatcgtcagggagacgtcagcgttgccgcgtacctacgcacttgcggcgcaacatgcgcagaaggcgcgtgaggccctccaggtccttcccagcactcccgcgagggatgcgctggaggcgcttactatgaaggtcttgtcgagggatcattaa

SEQ ID NO: 101 - DNA, 1029 bp, Schizophyllum commune
atgtcctacccgcgtcgcaagatcggagacgcaaccttcgggcctctaggatacggcctcatgtgggatgtctacgaccctcaaggcctcacttcctctaccgatgacgagcgctttgcggtcctcgacgctgcattggaagcgggctgtaacttctgggatactgctgacatctatcccggttccgaggaagccgtcggcaaatggctagcgaagacgggcaagcgcaaggagattttcctggcgacaaaattcggcttcgtgcagcgccctgggcatgcgaaggccggagagaagctcctcgacggcagtcctgagtacgtccatgaggctgtcgagcgctctctcaagaagttgggcaccgactacattgacctgtactatttgcaccgagcggatccggacacacccattgagcgcactgtcggcgcgatggcagagctagtcaaggagggtaaagtcaagcaccttggcctttccgaggtgtccgccaagacactgcgtcgggcctacgctgtgcatccaatcgctgcggtccaggtcgaatactcgcccttcacgctcgacattgaggatcccaagatcggtctcctgcaagccgcgcgcgaactcggcgtcaaagtcgtcgcatattcgccgctcggccgcggtcttctgactggacatatcaaatccactgccgacattacggaccccttccgctcatctatccccaagtataacgccgaaaacttccccagaattctcaacctcgtcaaggagctggaggccattgggcagaagtacaattcgtcttctgggcaggtcgcacttgcttggatcctggcgcaaggagatgacttcatcccgataccttgcacaacgaagaatctggagcacaacgtcgccgcgctggacctcaagctaagcaacgaagacctggcctcgatacgcagacacgccgaagagatcgacgccgctttgcgcggcatcgcacgttatcctcccggtgtacaggaaaccctattcagcgagacgccagagctgtga

SEQ ID NO: 102 - DNA, 1341 bp, Schizophyllum commune
atgctgccgtatactgctcctgaggcatatgggagatggaagacgaaggtgcggatatgccacggtcccaccgaacccattcatcgcattctgcccaagccgcgagcgtttagggcctcatataagggccgaaccctcgcgatcacccctccagctcttcaagccacgatctgcgccgctctgcaactcatcatgacgtggaaggtcctctacgccgcgttgaagaacctaatctcgtacgcgatgctggtgactgcagcgcccctgtcatctccgacacaccagcaggccttacctgcgcttccaaagctctcgccggaggaggagaggatcgaaatgcaggataagctcgggaggtatattcaggagatgcgggagacattcatccaggacctcacgacgtccaacgagcttctgacggagatttcgcaatactatgcgaagcgaccctcgaagctcatgcgccctcgtttgattcttctgactgcgcttgccgttaatgcgagcgttggcgaacgcgatgctctgcctcagcaggtccgcctcgccgaggtcgtcgagatgatccacgttgtctcactcctgcacgacgatgtcatcgacgaatccgacacccgccggggcgacatgtccgcacccgccaggtacggcaacaagaacagtatcctcgctggcgacttcgtccttggacgcgccatgtccctcatcgccacgctcgggcacttcgacgcgatgcgcgagatcgcaggcgttgtgactacgctggtcgagggcgagatcatccaggcggaggactccattgcgctgagcgacaaggcgagggcgggacaggcggcggaccagtgggggtcgtatatggagcgcatcttcttgaagacgggcagtctgtttgcgcgcgcgttgaggagcacggcgatgctttctggcttgccgagcgacgacgagcgggtgcttgcggtgggagactatggcacggagctcggactggcgttccagatcatcgacgatgcgttggatttcaaggagactcctgttgacagtgcgggaaagcccacgggcgctgttgacctgagccttgggctcatcaccgcacctgtcttctacgcactcgaggagcgcccgaacgagcttgcgccatatgtcttgcgcaagtgctccgagccgggcgacaccgcggaagtcgttaggctggtcagggagacgtcggctctgcaacgcacttacgcccttgcagccgaacatgcgcagaaggcgcgtgatgccctccaagctctcccaagcactcttgcaagggatgcgctggaggcgctgacgatgaaggtcttatcgagggataagtag

SEQ ID NO: 103 - DNA, 1026 bp, Schizophyllum commune
atgtctgcattcccgccccgcaagattggagatgccaccgttggcgctctgggatatggtctcatgtggggtgtctacgaccccaagagcattgcttccagcacggacgaggaacgcttcgcggtcctcgacgctgctatgaaggcagggtgcaacttctgggacaccgcggacatctatccgggttctgaagaagccattggcaaatggctcgccaagacgggcaagcgcaaggaagtcttccttgccacgaagttcggcttcaagtttagcggggttggcgagtcgtccattgacggcagtcccgcgtacgtgcgcgaggccttcgaccgctccatcaagaagctgggcaccgactacgtcgacatgtactacttgcaccgcgcggacccgaacacccccatcgagcgcactgtaggtgccatggccgagctggtcaaggagggtaaagtcaagcacctcggcctctctgaggtttccgcgaacacgctccgccgcgcccacgccgtgcaccccatcgccgccatccaggtcgaatactcgcctttcgtactcgacatcgaggaccccaagattggcctcctccaggctgcccgcgagctcggcgtcaaggttgtcgcatactcgcccctggggcgtggtctgttgacggggcagattaaatcgcccgcggacttcaccgaccccttccgctcaaacacgcccaaatacagcgcggagaatttcccccggatcctcaacctcatcaaggagctcgagaccatcggcaagaagtacgaggcttcccctggtcaggtcgcgctcgcctggatcatggctcagggtgacgacttcatcccgattcctggcacaaccaaggtcaagaacctggaacacaatctcggcgcgctcaacgttaggctcagcagcgaggacgtcgccaccatccgcaagtacgctgaggagatggatgctgcgctgcgtggtgtcgcgcgctacccccctggtatgcaggagcagctctttagcgagacgccggagctgtaa

SEQ ID NO: 104 - DNA, 2970 bp, Schizophyllum commune
atgttgccgctcttgtccttccacagaactgtgctggaagacatacatgacccaactaccaacgatctgctggtcatcgcgcgagggttgggactgcgccggattgtctgcaacctgctgaagctctatgactccccacaaaacctcgtccttctggttaacgccacgcccgaggaggagtctgagattggggaggagctgggtattatgggctgtcggaagccggggctgcgtgtcgttggctacgagacgggcagcaaggagaggcaagagatgtacaagaagggaggccttatatcagtcacctcgcgtatccttgtcgttgatatgctccaatcccaaatccccaccgaactcatcaccggtatggttgtcctgcacgccgaaaaagtgacagccttggtcctcgaagcgttcatcgtgcgactataccgagagaagaacaaggaggggttcttgaaggcgtttacagaccagccagaacacatcaccagcggattgtcccctctcaagaacatcatgaaggagttgcagctgcgcaaagttcatctctatcccaggttccaagaaggcgtaaagaaggctctcgagagacggcgcgcggacgtagtcgaactgtcccaagaaatgacagagtcgatggccgaaattcaccacgccatcatacagtgcatgacttcgacgcttgctgatctgaagcggtccaacacctcactcgacctggacgacctcacggtggagaatgcgtacttcaggtcgtttgatcatatcgttcgccgacagctcgacccagtgtggcacaaggttggtccgcgcaccaagcagctggtcggggacctggcgactttgaggaagctcttgggatacctgctcacttacgaccccatccaattctacatgttactcgagaccatcatcgagtcaaaccagacgacctcgtcaggcggaaagaaggagcaccactcgccttggctgctcaccgacgccgccaacgtcatcatcaccgtcgcgaagcgcaggtgctacatcatgacttccactaggaaagagcccgttctcgatgacatggacgaagagggctgggcggctttggacgaggtcaacggcacggtcggtcagtcgcaagatacgggcaacaacagaccgcgatggctcccgtcaggggtagagcctgtgctggaggagcttccgaagtggaatctgctggccgacgttatacaggagatagaggaggagctcatccgcatggagacgaatccgcggatgaagaatacccctggaaataacaccgtactcgtcatgacatcctcgacgcacgggtgctcggtgctgaccgagttcctggagagcatggactacagcgcacccgcgggccagcgcggcacgtcaatgctgctgatgaagctcgggcgctacctgtggtggaaagggcggctgcatcagacgaagaaggcagaggggcgaggcgagcagaatgggtactaccgcacgaatacgggttcgtcgacgaataccggaccatcgacatcaacatcaaacatgaacaggagtggcaacaacgctggggtatccgaggcgctacagcggaaggataaggacaggcaggagcgcgccgctagtaggaggcgtatgcgtggggggaagacggcgccagcgcctacaccctcgcggtcgcagtcgaccgctccgagttctgtcgtggacgatccggtcgaggctgacctccttacgcaactcataagccaacagtcgtcgggactggagttcatggatgacggggacatcacgcttctcgattttgacaccgtccagttcgagacggagttcgatgcgaactatgagctgttggcgcctcagcagacagtcgtcgtgcgcccgtactcggatgatgcggacgacatgatgcttgccgagctgcaacccaagtttatcgtcatgattgagcccaacgtggacttcttcaggcgggttgagctctaccgcgctgcgaatcctggactcggtgtacgattgtaccacatgttttacggcaactcgtcagaggagcataagttcttggcgggtattcggaaggagaagaacgccttcgagcggttgatcagagaacgagggagcatgcttctgcccattttcgaggatacacgacaacaagcaggcgacgatgtcatcaagaccatcagtacccggatcgccggcggtcgcagagaattgaacaccgagccgtcgagggtcatcgtcgacatgcgcgagttcaggtcgaccttgccatccttgctgcacgcgtcgaacttgctggtcatcccggcgactttgaccgtcggtgattacatccttacgccagatatctgcgtcgagcggaagagcttgtcggatcttgtttccagtttcaacagcggtcgcctgtatacgcagtgcgagataatgtcagtacattacaaacatccgatccttctcatcgagttcgaggaagagaaggcgttctcgctggagataatctcggacatgaagtcgtacgcgaagcccgtcaacaagtacccgcccaaaaagccaaacacaaaagaagacgacaaatcacctttctccgggcccaccattcagtccaaactcgtcctgctcacccttaccttcccgcgcgtacgcatcatatggtcatcctcaccgtacgcgaccgccgagatcttcaaggacttgaagaaggacagtaccgaaccggacccgacgacggctatcgcgattggcgcggaggaggacccggatgtgggcgcaggcgtcaatacggcggcagaggagctcttgaggtgtctgccggggatcacgcagaagaacgtgaagtatgtggggagcaagatcacgaatgtacgcgagctctgcgagatgagcctggcgcaggtgcaggagcttttgggcgcggagccggggaaggcttgttgggactttctgcattatgggtcgaggaaggagggaagctag

SEQ ID NO: 105 - DNA, 1674 bp, Schizophyllum commune
atgtcacgcgtgaacgtgaacagccagacgacgatcaacgaggtgggcgccgcagttcagggtgaggtcgtcgcgaaaacgcacaagggtccccgattctggctcatcttctgctccatctgtctgtctttgtttgccgcggctctcgagctcacggtcgtcagtacggcacttccaaccatcgcgagcgacctgcacatcgatgagtttacctgggtcggttcggcgtatgctctcgcttctacggccttcctccccatgagtggcgccatggcggaggtcttcggacggaggcccgcgctcctattctgcttggcctgcttcttcctcggtagtggcatctgcgggggcgcaagtaacagctccatgatgcttgccgggcggaccgtgcaagggttgggaggcggagggatccaggccttgggctacatcgtccttgccgacatcacgacgcttcgcgagcgtggcgtttacgcgagcctgttcggattaacatggagcattgcgtctctcattggccccatcgtcggtggcacactcgccgacaaaggccagtggcgctggatcttctacatgaatctccccatcgccggtgtggcgtccgtcctcgttggagttttgctgaatttgcccacgccgccgggttcaatccaagagaaactggccaagattgactggattgggaacgtcatcgtcattgggagcacgacctccgctgctattggacttacttggggcggcgtcacggcgccctgggactccgcgcagactttggcgccgctaatcatcggactggttggtctggtgcttttcatggtgtacgaggcgaagtgggcgaaaaatccactggtgcccttccacgtcgtcaacaaccgcacgagcgtcagcggctatctgcaaaccttcatctcggcggtgggcgcgctctgcctcacctacatgtatcccgtgtacttccaggctgtaaaaaatgcgacgcccatcaagtccggcgtctaccttctgggcatgtctgccttggttcccgcggccatcgtcgctggtgtgatggtgaagaagacaggccgctaccgcccgcagatgctcgttggctggtgtctcccagtcattggtactggcctgatgagtacgctgcacgcatatcacaccgttggccgcgccattggatatttggttatcgttgccgtgggcatcggcgccgtatactcgacgacgatgttccccatccaagcgccgctacctgtgcagtctagcgcgttgtcgctatccttcatgtctttcgtgcgggcttttgccggaatctggggcgtcaccatcggcagcactgtcctccagaaccaggccaacaagaagctcccccagtggttcaaagaccagctaccgggcggcatcgacgtcgcgtactcggccattccacggattccgatgctcccgccggaccagcgatttgaggtgaacgaggcgtttgcgctgagtttgcaggtggtctgggaggtgctgattgggatcttggggttggggctgctgtcggcgctgttgatgaaggggattccgctccacagcgtcgtggatcagaagtggacgatgcaggagaatgcggcggctgccgctgctgacaaggagaagaatatcgagatggaggcggtggttgacgacaagccggtgcatgcctga

SEQ ID NO: 106 - DNA, 291 bp, Schizophyllum commune
atgatcttccaacaacctcgtgggggtggctggcccagggtcaggactgttcttctgcgggccgtgagccgtaataagctgtccgtcctgtcgctatctgcctcttcttcatctttcagaggctcagaagccattgtcttcgtggcttcctcagaccagagttgtgctctattccgacacgaggttgaaaggggacggaaacccgcgcgggtcggacggactgccgagccatcccctcaaagtcttaggtacggtcgtatctctgtacattttcgctgtcgttgtgagtga

SEQ ID NO: 107 - DNA, 888 bp, Stereum hirsutum
atgattcttcttctactgttatcccttcggtccatcttccaactcgccttttatcatgtatacactttatatttattcacttcgactgactacaaaacagtttttatcccggttatggtcttcgcctgctcgaccgctcccatacattcggtcgccaatcttctccatggaggcacatggatatggatgcacctacttatgtgtaatgtctcgaaccaactgagaggggagcaggaagacgctgtgaatcgaccgtggagaccactgccatcgaccagaatgaccaagaggcaagccacggcactccgctggtttacggtggcatcatgtctgctctactcgtccgcctacggccaccgagtagtatacgttactgtcggccttttcttcacaacatatgcatacgacgatctaggcttctcccagagtccgctcggaaagaacttttgtaacgttggtggatacgcgaccttcgagatcggtgccacaaagatcatgggtacacagcacgagctagacactacctcactcacgtccgttcttcttagcggcatggtgatatttaccactatccaagtgcaggactatcccgacatcgaaggcgacgcagcgtctggtcgggtcacctttccgatctatgcacccgagttctcgcgattattcacgctttcagcgatcattatctggtccttcgttttgtcatggttctgggatatcggcatcctgggtcagtgctttctcgcaggattgggagcatacgtcggtgctcgttactatctccatcggacaccaattgcggacaaaaagtcctacaagctcttcaacgtttggctggtgctgatacatcttcttccactccatgcccgcatccgcgtgtttctctattag

SEQ ID NO: 108 - DNA, 1374 bp, Stereum hirsutum
atgaactatatactatcctttgttgttccacttgtatcacttgtgatgctcatattcatacgaaagatgaagcgagacagcttcggtgcacatcaatatcctcctggtccgcccgcgatacccgtgcttggaaatatcatgaccattccgaagacgggagcatggaaattccttctgaagctgcatcgcgactgtggagaacctatcttctttcgcggcttggggaacagcgtccttgttctcaacacaatgacctccataacggatctgctcgacaagcgaggcgagaactattctcatcggccggtattgactgtgctaggggaactgatgggattggatcgtagcatgccgatgttaccgtacggccgtgagtggcgagagcagagaaagctcgcccacgttgccttgaacccctctgccgtgagaaagtactgcatcgtgcaggagaacctagcttctatattagcgcttgatattctcacgtgtcccgagggattctttgatcatgtacgactttacgcggagcgtataatattctccgtggtatatggtgttgatatcgatggttccagtaatgaatatgtcactcaagcagaagaaaccatgcaaattgtgggtgacgcaatggtcccaggggcatttatttgtgatttgttgccttggatgaagtatcttccttcctggttgccttttcgaaagcaggcactttatgggagaagcatgatcgagacccttgttaccagaccctttgaacacgttcaacgagagatgatgaaagatattgctgcgccatctctcactcgagaactattgaccttgcgaaataacgcccccgcgtcttttgagagttccgtcaagtgggcaactggatctttatatggtggtaggtatcagacttggacgtacgccaccatccttactttcatcatggcaatggcaatgaatcccgagactcaacgtaaagcccaaaagaagatcgatgaaattgtagggatgcacagacttcccgtcgtctcggacaagacagagttgaaatacgtagcagccgtcatcaatgagacaatgagatggcatcctgtgttaccgctgggcatcgctcgccgtacggaccacgacgatgtgtacatgggatacttcgtaccaaaagatactgtcgttttccctaacgtgtgggcactcacacggaggcacagcgacacatacgatcccgaaaaattcatcccggaacggtttctcgacccctccgaagcagcggacgatccttccacttatttgtttggatttggaagaagagtctgcccgggtaaatatctggcggacaactcgaccttcattgcaatcgcaactatcctgtctcccaatatgagctga

SEQ ID NO: 109 - DNA, 1425 bp, Stereum hirsutum
atgtttcctcttcccgttacgaactggaccgtagttcacgctgcattgctcatttcaatcgtgctcgtataccgcaggctttttgtacgacggaaatctcctcttgatccgttgccttatccagacgaagaaccagagtggatatggggccacgaaaaacgggtttatgacagccctccagggcaagcgtatttacggtggatgaagagcgttgggcatacttatcgcatttgtgctgcccttggtgccccggacgttctggttcttggtgatacgctcgccatttcttatattctacaagagaaaatttacgactaccggctcaaaccgttaaagacatggaaggcgaaatatttcaagcaatgtctacggctagtcttaatagtcttagatgatctatcacaagcagtcgaggactcggatggtgaaatgggcgtaaacatattgtcatggacgaatcgaatgaccttgaatgcaatcggacgcgtccgtgattcccaggcattcttgtacgatttcgaatccgggaagagtcgcgaggcacagcttatactggacacaaggcgcaggtcgctgaccggtattgctcgatacgcatcgttcttaaccctcatgatgctcaggcggttccctgccctcaatagccttcctgtacccgcccttcaggcgcaaagcctagttacggcaaccataaagtctgtcgtagccaaggagatcatagcgagaagttcttcagcatctgatctccgaactcgaggcaaggacctgctaagccgactcttggtagctcatgatgagcagcacctttcagtcgaggagatgtacgagcacatatcaacgttcttagtttctggacaggaaactacgagccaaaccgtcgcgttctccatctacgagctttcgcgtcacccagagatccagcagcgtctaagagaagaattggacacgtcttacccgtcttccacagggatgtcgcagtcgcagcaatcttatctgcatgccgtgcttaaggaaacactaaggatgtatcccgctcttctgtacatggaacgtgttgccaccaaatctgatagaattccgcttcagactcacatcagtcacggtaaagaccagccgctacaggacattcatgttgaaaagggccagaccgtcatcatcccaattatatctctccaccgctccgacgctatctggggcgatggaaatgtctttcgtcccgagcgatggcttgggactttacctgatgaggcgctgcgtcttccaggatggtctaacttgctttcattcagtgatgggccccgatcatgccctgggatgcgaatggctcatattgggctctctggtcaagaaatatcgcatagaaagcaagaactcagagatagttctcaggatttcatccagtttgcagccttgggtgatagatga

SEQ ID NO: 110 - DNA, 1440 bp, Stereum hirsutum
atgcatcttccattcgcctggataatatcgcttattacgctcgctggaattgcgtgctggatattcaaacggtgtttcacactccggtatctcccgcttccgcctgggccgccaaacaatgtgtgcgaaaatgaacacaagtggatggcttactcacggtggtcgaaagaatcaggtcctctcgtcacactgtccacggcaccacgcccaccgatggttgtcagtggtcgcacagcaatccgagatcttctgataagaaagaaatcgttttgttgcaggccacgtgtacctatggccgagctcatggggagacaaaacaatgttggcttcacgtactacggaaagcgactcatccggatgcgaaccctgcttcactccgcccttaacctgactgaagttacctccacgtggattgaactcatcgactaccaggcggataatctctgtagagatttcattgtttctccggaacggttctacagccaggttgaagccaatatacagaaactcattggacgctttacttatggccacgagccaagtccagagtatctgcgaatggcggccgaggtttcgcgacacaccgggaaatccgtggaggcaggccgatgggccgtgaacagttttccagctcttatgtgggtacccgcatggatgcccggtgctggtttcaaaagatacgctatcgatgcaagaaatctgttcacgcgcctgctcaatgaatctgtcgcgctcgtaaagcagagaatggaccaaaatgaagcgggaacgtccttcgttaaacgatctctggaaaacatctcgctatatccatcatgtatcgatgagtcacttgttatatctgccgcaggcagcttgtttagtgcagggacagagaccttgtcaggtacaattctttcttttatcgtcctcatggcaaaccatgaagatcttcaagagcgtgcgtatgcggaaattctgtctgttgtcggcacagataggtttccgaattgtcgagatcgcccatcgctcatctttgtggatgcacttatccgagaagcataccggttcaatcctatcgtacccgtggttaaccgtagcaactacgaagaggaggagtacgaagggcatcttattcccaagaagacttggatcctcgtcaacctgtggtccattttacatgatcctaacgtctatccatcgccagagacattctttcccgaacgttttctcaactccgataaggacatcaatcccgatccccgctcttttgtttatggttttggacgaagaaggtgtcccgcagtggattttgcggatacaacactttttattaccataactcgccttctgacagtcttcaaaatctccccggagatggttgacgggaatgcatacccacccccgctggaagttagggaaggatttactccggctccaaaaccgttccgattgtcctag

SEQ ID NO: 111 - DNA, 720 bp, Stereum hirsutum
atgaccacctttgaacatgcacaacaccgtatcataaacacaccttctggatcaatcgtcagagagtcagccatcacagacccagtgaccgcagtaggaagcggttacgcggaaagcaagtgggtggccgaaaccttactgctcaaggctgcagacgtactcggtgctcgtgtgacgattgtacgagttggccaactttgtggagaccgagcccagggcggatggaacgagacagaatgggtccctgccatcgtgcgcagcgcacaggaactcggcgtgttgccatccagggacgagaaaatcacttggctcccggtagacgtagcttcatctgcgttgttggagatggccggttcaacggaggcgatcctacacctcgttcatccctcacccagcaagtggagtctcttctccgatacaacttcgtcgattttgggcataccttctgttccgtacagggactggattgctgccctgcggaagacctgggtcgaatcatcggactccgacaaagcgatgatcaacatcccggctctgcacctcgtcgactttttagcggagtacactgaagcggccaatctctctgtggaacgcgccacaattgtctcccgaagctcgagagatgcgaggagattagatgaagaggatgtgaagctgtggctcgcgtattggaagagtagagggttcttgaagtctgacgcttccgctcctgctgcgtga

SEQ ID NO: 112 - DNA, 1767 bp, Pestalotiopsis fici
atggagttgttgcgctcgcagcttggaggggacaattcgctctggaactttgcttcggccaccactacaggactcgcaggtgtcgttaaacttcggaacgggttggccgattatctgtttagcgagacccattgctacgagtccattcgaacacactcactatcggaacctcttgcgaattgcttcacagtatcgccgtcaggtatctttacaaaggtctaccatgaccccaatgtcgccaatggggcaagcaagtcgcaccaagggcatgttataccgggactctgggatggacacggccacctgctccaatatggagagttcctaaactcggtagacttgttcggatcagcttcattcgaagacatcattgttcgtgtcgacaactacctcgatgaacatccagacgcgggaaatgcggataattggttgagaggaaccggatgggaccaagcagcgtttggtcgcatgccaacggctgacgacctcagtgttgacgaacgtctcaagggcctgtatatcatgctggatcgcgtcgatgtgcattgtatatgggtttcgcagcctgtactggatctattgcccgatgaccttcctgatgtacccggtggagaaatcatccgaaagcccggcctaggtgtcttttgtgataatgcaatggacatgatcatggcactctggccaaagcccgacaataagaagaaacaaaagtttctccacagtgccatgtccaagctgaacgaggttggactcgttggcatggctgatgcaggagtttcccctagtaacgccgctctgttcaaagagcttgcgggcaccaaggactggactttgcgagtctatgccatgcttgaatgcgatgagcgcaataccttttgcccagagcacgcgaagaagcatagcagggaagacgggttcctcagcatacaaagcgtcaagctcttcgccgacggcgcacttgggtcttggggaagtgccatgattgaaccctattcggaccgccccggcacttcgggttctttgctcataaacgggaccgagttggcccgcataacaaagctttgggccgaagcaggttttcaagtgaatatccacgccataggagatttggcaaacagatacgcaatagatgccatgacgggagcccttgaaagtatttgtccggacgaaagtcttgcctcatgccaagctcaaaaacgcttccgcatcgagcactcccagatcatccacccagacgaccaggcacggattcatgctatcggcatcattccatcgattcaacctacacacgccacgtcggacatggcttacgccgagaagcgcctcggcaaggaacggacaggcagtggggcctaccggatgcgctcgctcctcgatatccctcccatccttggcagtgatttccctgttgagcctccagacccgttccagggcatctacgctgccatgacgcgccgaagtccgcacactggccgcggaaccgaggatcagccagacgggtggtatcctgaagagactctgagtctagatcaagccttgcgcggttttactgaggcgccagcgtatggcgcttttctcaagggcaaggctggcgtaatacaagaaggcgcctttgccgactgggtcgttctcgacatgcccctcgaggaaaccgacgtagaagacctgcgcgcctatcgtgtgcgtgagacttggatagctgggaagagggtctttcggcgagaggaggatgagtcagaagtgctgaatatcgccgatgaattgtaa

SEQ ID NO: 113 - DNA, 720 bp, Pestalotiopsis fici
atgaatcgacacttctttgggccttctaaagggttgcccctggactgcctcagcagacggcccgaggtgtacatgaggagcggcatgccctcctggactcaggattggacggccaagatcgtggacgacgagctttttctcagggtcatccacgtctcgtataggaaggatgaccagatgcctcgaaatacacgcccatggcgagaaagacaatacttttgcgcacataacagagcgcccaagatgcgccgtacctataaaggacccgcgttactcccatgggtcgaaatccgtcgtatagccgggggacccaacgggtccgaagacagttaccgtactgtctatttctcgtctcctggcgtcctgcattcttgtaccaaatgtttgacagacttttgcatttccgtcgagcagattacagagcgcaagccggcaaagaacgtcgtcactgccgccgatgcgagtacaacaacaacaacggcctcgagttctggggctgctcaagtaaaccacggtactggcgtctccaaaaagcccgagtttccaatgccaggcacctggcggattacagtcactgcctatcaccagatgggtagttgccgtacacccaacgacccaaagtggcaagccttggtacttactgagagagacaagtattatcgagaccaccaggcataccctcctggatgtgtaaggcgaaagtgggaacaggcgaattga

SEQ ID NO: 114 - DNA, 795 bp, Pestalotiopsis fici
atgagatttctctgtttgccaggcgcctatgccagtgccgaaacctttcaagttcaactcggtccctgcgtagccgaggtcgaggaggcaggcaatgccgagttcgtctggactcagggcacatactctgccacgccgccagacgggttcaaggatttctttggccgaggtccccactaccgcttcttcgactacgacggacatcaggcttttgatatactggagaagattcgcgatttccccgaaggcgccaacgcagaagaaacaatgagacagctcatgggggacggagcttcacatactgccaaaagtgtgcgcaatgcactgcaggtcttgattgacactattgatgcagacccgcaaattgaaggtatcctgggatattctgaaggagccaccaccgctgcaagtttaatcttggaggaacgtcgcagattacaagagactggcaggccgaggagaatcaagtgcgcagtcttcttcgcaggttggccgcccttgtctctccaagacggaaaagtgcaagtcttgctcgccgaccagagcgaaagcgtcattgacgttccgaccctgcatgtgataggatgcaacgacccgtacattctcggagccatggccttgtacaacatgtgtgacgaggattcggccgagatctttgaccacggaaagggccacacggttcctcgggatcggaggaccgttcatgagcttggcgacgcgtttcgccgcgtcgtgagcagggaatactcgtggcaaagcaatctgattgaggtcaaggggcttgacataaactag

SEQ ID NO: 115 - DNA, 6780 bp, Pestalotiopsis fici
atgacgtcctcaccgagcaacccagccactatcaatggccaggccagagagcagccacaactcatgcctatcgccatcattggcatgtcatgtcgcctctctggagatgtgtccaccctggatgatttttggcaaatggtgtcacgcatgcgctgtggctggtccgagatcccaccggagcgcttcagcaaagatgcgtatcatcacccaaacccagcaaagaaaggcgcctttaacacgactggaggatatttccttaatcaggaccccgcgctctttgacgcgccctttttcaacattacacaggctgaagccgagtccatggatccccagcagagacttctgctcgagtgtgcctacgaagccatcgagaatgcgggagtgccaaaggagcagatagtcggccaacgagtcggcgtctttgtcggaggcgctgcctctgactatcgacttggaacgctgcgcgacctcgagcaaacgccaatgtttgacgccacgggtaaccaccagtccgtcatgtcgggacgtatctcgcactactttgacctgcgcggtcccagtttcactgtcgatacggcgtgctcgtcatccttgtatgcgttgcatcaggccgtgcagagcattcgcagtggcgagtctgaacaagctattgtcgcagcttgtcacttgaatctgcaacctggagactgggtatcaatgtccttgtcacggctattctccgatgaaggcaagacttatgctttcgacaaccgtgccaagtcaggttttgctcggggcgaaggtgccggtgccctgatcttgaagccactcgatcaggccttgaaggataatgatgcgatccgatccgtgattgtcaatacgggagctaaccaagatggaaggactgttggcatcacctctccgtcgggcgcggcccaagagcagttgatgcgtgaggtatatgaccgggcaggtattaagcccgaagacgccggcttcgtcgaggcgcacggtacaggaaccaaggttggagaccccatcgaagccacggcaatccacaacgtgtttggtcaaggaaggacatcaagacagccgctttatcttggctcggtgaagagcaactttgggcatctggagaatgccagtggagtaatttctgtcatcaaggcggcgatgatgctgcaaaaggggtttattctgcccaacacaaattttgcttgcccgaatgagaatattcccctcgtgcagtggaacataaaggtcccagttgcgcaacgtccatggccatcaaataaaaagtacattagtgtcaacaactttggctttggaggctcgaatgcacactgtattcttgcagcacctccgattgttgaaaaaccccgacaggatgtcgacagtcaaaaggccgaagcacaacagcaccagcgtgtctttgttctttcatccagtgacgaggcttccgccaagaagaccatggagcagctcaccatattcttggagcaacatcccgaggtcttccaaaaggggctgatgcgtaacctggcgtacactctttgccaaaggcgttcgcatcccccatggaaagtcgctgtaacggcaaagtcggcatctgagctggccgaggcgctggcatcctcagacaccaagccggcccggacgtcacaggtccccaagatcgcctttgtttacactggccaaggcgcacagtggcatgccatgggccgtgagctgcttggacgctatcacatctttagcaatgtcatccaagaagcggatgattgcctgaagcgactcggtgcagacttttccttgcttgaagagctctcgagagacaaggaaacttcccttgtgggtcgagcgcacatcagtcagcctatttgctcagcagttcaactcggtctcacagaacttctcaagtcttggggggttacgccacttgccgtgactggacattccagcggagaaataggtgcagcctacgctgcgggtgccctatcattggattcggccatggccattgcatactttcgcggccaggcagtggtcaagatgaagcagacttatccagatctcaaaggctccatgatggcagtaggtgctgggcccgatgaactgcgaccactagtggagcaacttcgcagcggtgaagccgtggtggcctgcgagaactctccgagctcagtgaccatctcgggcgacgaggcagctattgatgagctggccatcgagatggagaagcggcaacttttcaacaggaagctcagggttgatgttgcctatcactcgccacacatgaagctcgtcgccgacgactataagcggttcattgaggacattgtaccacaaaccggcagtcctgtacagttctattcgtcgttgcacggccacaaaattgagctctcaaccctggacgcatcgtactgggtcgacaacctgacccgcccagtgcgcttctctacctctctcacggaactttgtctaaacagcgcgccagatgtgattgtagagattggaccacacgcagcattggagggaccagtcaagcagacactgaagcaacttggtcaacaagtcaagaagactacttatttgtctgccttggtcagaaacaagaatgccattactacagtattggagcttgcggctaaactgtactcaaagggtcaagccttgcaatttacacaaatcaatttggaagaggaggaaggagatcggccacaactcgtctcggacctcattccttatccctggtctcgccaacggtactggtccgagagtcgcctgtctttgcagcatcgccaaaagccttttcctcgtcatgatttactgggaagcatggctgacttttccaacgatttggcccccacatggcgaaacgtcctcaggacggacgacattccgtggctcaaagatcacaagatgcagtccctagtgacgttcccctttgccggctttgtctcgatggctgtcgaggctgctgctcagcgagcaaagttgcgtggcgtcgagttcgagaggtttagcctgcgcgagattcaggtcaagaagccattgctcatggaggacgagtctgcttacgaagtcgtcctgtccatgtccccatttcctgaaggcacgaggtcttattctgatgactgggacgagttccgcatctggtcttgggagcagggcaaaggatggatggaacactgtcgcggatcgatcgctgcgaacaagggcggtaaagcaaacttgatcagttcagctcataccggcatcgcgtctcgtagatttcaggtcgcagacgaagcgtgccatgaacacgtcgacgtctctgctttctatgacgaacttacagcacaaggtgccatctacggtcccacattccgcaagctcggatccatccgcgccggcagtggttactctgtcgccaagtttgacgtggcagatacaacggcgaccatgccactggaacatcagacgccctaccatgttcatcccacattgttggaccaggtctttcagctgtcctttccgatattgggcgccggtcgttgcggaatgaccactctatacatgccctcggcgatccaggagcttcacattacgacagatacacctgcggctgtcgggacggagatatacgcaattgcacaaggcgctccagacctcgaggcgcccagggctgtcgactttgtcgtcgacgctcttctccgcccggacgacgatcaagccataatcagcctcgtcggcttgcaaatgacgcccgtcaagagcgagagcgccatcagcgacaaggcttgcaaactttgcttcaagatgcaatgggatcccgtggatgagactgagggcgattcaagtccttcaacaagtcccacgtcattcgaaggtagcgagggcggctttgactctactggcaggtcgtctctcgtggcgagcatggatgagcagagtctaaacgtgactagtcaggttctcaaatcctgtcctcaaccactgctcgtctgcaacgattccaaagatactcttgagagaagcaaagatgatgccaacaaggccgagcaagcgattaactcgctatgggcgagcaagtctaccagaatcgtttcttgccaggccgagtgcaactttgctacccttttgagcgagaccttttgcagcaaaactggtcaagatgctctgatctgttcacttgataccttgactgacatggagaacacccatatcatcatgtgtgagcttgaaaaacccatactctcggacctcaaccaagagtcttttgcaagaatccaaaagcttctcgtgtcctgtgccggggtgctctggatcacaatgggcgcctatctgaacgcgaccaacccgactggaaacatggccgttgggctaacgagaacgatacggtcagagacggctgccaagatcgccacgcttgacttggacccagagtcggagctgcccatttatgctcaggccgagctcgttttggagacctttgacagggttttccatgacgataccgttgccgatatggaatatgccgaacaggacggacggctggtggtaccgcgcatcatggaagatgtcgagatgaacgactttgttcatcgtgaactgcacagctcctccccgtacctacagagctttacgcacgagacgcggcgtctgaaaatgaccatgggtactacgggagctcttgacacgctgtttttccaagacgaggaggtctactcgcttggcaaacacgaaattgaaatccgcgtcgaggccacgggcatgaactttaaagacgtggtcattgccatgggacaacttccaagcccatacattggcatcgagtgtgcaggtaccgtatccaggatcggcagcgcagtcgagcgtctggccgtaggagatagagtctgtgccatgtccgaaggggcgtacagcacgtttgcgcgatgcccggctaccagcgccgccaagattccggcagacatgtcctttgccgcggcatcttcgattcccgtggtctattgcactgcctattatggtctcgtcgagcttgggagactttgcccgggcgagcgcgttctcatccatgcggcggcgggcggtgttggacaggcggcaatgcagctggcccgaatgctgggcgccgagatttacgccaccgttggtagtccggagaagaagaagttcatcatggacaattatgggattccatccgaccacatcttctccagtcgcgatactgcttttggggcggccattcgtgaggccacaaggggcgctggcatcgacgtggtccttaactcgctggcaggggactttctgcgcgagacgtgggactgtattgcgcactttgggcggttcatcgagattggtaaacgagacatcacgtccaacactagattggagatgtccaagtttaaatacaacgccacttttagctctgtggacttgacagtcttggccaaggagcggccccagcaaatgggcgaaatcttcacaaaggtcatggatctctttgacagcggtgtggttcatccaatcttccccgtcaccgtgtttggtatctctgaagttgaaaaggcgttccgtctgctgcagagtggcaagacgactggaaagcttgtagttgtcccccgtcctggtgatcaagtcaaggcaacgcatctgaagaacagctctaccagcctcttccgaggcagtgctacttatgtgatcattggtggcactggtggattgggccgatccatgactaggtggatggttggaaagggagctagaaacattgtacttctttcccggaccggcgccgttcaaagccatgtggccagccttgtagaagagatggagcaattatctgcaaaaattgctgtcaaggcgtgcgatgtcgcatgtatggacagcgtaacggaggttgtcagctcttgtacccaggaattgcctcctgtcgccggtgtcatccatgcgggcatggtgctaagagatgttctcttcgaaaaaatgacctttgaggactatcaaaccgtcatacgctccaaagtcgctggcgcatggaatatgcacaacgctctagcagggaagtctcttgacttctttattgtcatttcttcagccgccggtattgtcggtaatcgcgggcaggcggcctacgccgcagcgaacacttttctcgatgcctttgtccggtaccgaacgcgcctcggtctggccgctacggcgctcgacctaacggccgtggaagacgtcgggtacctggccgacaatgcagaacgcaaggatgacgtgctgagaaaccttggaggtcagagtatgaatgaagccgaagtgctggcgcttgtcatggccgcagtccagggccgcatgcgtggttcgtgtggcaaccactgcatgaccggcctcgatctcggggaggacagcaccgcccaaagtctcccttactttgctgcagatgccaagtttgagcatcttcgccaggacttgccattcgcgcaggcatcagccgattctgcagctcaggtgcccattggcgttgccctctcccgcgctcaatcccacgaagacgccctccacattgtgggcgcaggacttgccagcaaacttgccactatcctcatggtgccggcagaggacttggatccagagacacccatcacaaaatatggtcttgacagtcttaatgccattgagcttagaaattggattaccaagtcactggaggctaacttgcaagtcttggaacttctaacaggtggatcgttgacgaatctatcatctattattattaagaaacgggtggctacaaaggatggggtcatcgggtctggtcacaaatag

SEQ ID NO: 116 - DNA, 1359 bp, Pestalotiopsis fici
atgccagcttttgtttctacaactcttcaagttgccattatcatgccttcgaatagtactatagacttacaacatcgtaaagcatgccagcagtgcaccaaggcgaaacggaaatgtgataaacagattcctacgtgtcgccggtgcatccgaaaaagggcccattgccaatacccaacaacgcggcggtacgagcgtaaagtcaaatcgcctcggcagcttcgaggcgcaagtaacgataccgccggtccacaattgccagtgcccataggcgagggtgcaacagttgagcgttgccaagctgaaccagcagtcgttggctccttcactgggtgcgacgactcagacatggcccaccactccttggagctgttgtcgccgattcctgtgctgccagtcgcaaacccggcacctatgagcaacctcgatgttcggtcctggttttgtggcccagatgcatggtcgatgaatcaccatattcccgccaccagctccaacctaagcttgccttcttccgctgtcaatgccttggccttgaaacaatgggtcgagtcaattcgtggttcactccgatattggattgaattcggccataacatattcattcacaaacatttgtacttgcacatcggactaccgtcatcacttcaagatgcgtggatggcattgacagcataccattccaagacgaaagaaaacgaggagataactctcacaatggtgggggatcgagcgcaaaactatattctacaacagtccctgatggataatataacgagcacggcatctactggcgatgtttggagtcatcttgttcgcgttcaaactcttttcatttatcaattcatccgtttatttgatggagatatacgccaacgagcattagccgagaaacaaattccgaccttggatgcatggtctgagcagctttggcaacaagcccagtttgatgcagagctgatgacggcccaaagcatcattggcagcggttctattcaagatgatggccatgacgacagcgaggaaattgcttggaatgaatggatactaagcgagagtgtccggcgcattcggctactcgtcaactttatgcatggtgtctacttgacactgcgggacggatgggtggaatgcaatggagctccaaagttcacggcaagaaaggggctctgggatgcagtctcgtcggctgactggacggtgctgctgcgaaataaggggccattatttgtatccttgaatcaaattgatcagctcacaatcatggcaaaggcggatgaagtagagacattctcatttgatttactgtcggcttccgtaaatcatggcaaacttgatacttggatcaggactttataa

SEQ ID NO: 117 - DNA, 768 bp, Pestalotiopsis fici
atgtcttctcaaaagatctatctggtaacaggcgccaacagaggcattggaaaaggccttgttgcagcctatatatccgagccagagactgttgtgattgcggcagtgcgtgatccgaatcacaagacttctcagtcactcgtcctactgccaaaggcgacaggcagcagtctgatcattgtaaagatggacatgcaatcaagcgcatccatttctgaagcaattgataccctcaagacacgccatggtatcaaaaacattgatgtggtggtttccaacgcaggcatcggcgaagtcactggtcgacttgttgagacgcctgtgtcagtgatccaaaggttcatcgatgttaatacttttggtcctctgaatctattcaagacttgcctgcccatgcttctggaatctcaatcacccaagttctgcatcatatctagccttgcaggatctaataattcactcaacacaatgctacctacagcaccgtacaacgcatccaagctcatggtcactcattttgctcggtggtttgccgtggaagttccagaggtgaccacttggtcggtgcatcctggattggttgacacggacatgggaatcacgggtgtggatgccataacaaagatgcagccagagatcggtgcttccttgaagtgcatatccactgaagaaagtgtagcaggtttgaaaacagtgattgaaggtgccacgaaggaaaatactagcggtcatttcctgaattacgatggtgcagagttgccatggtga

SEQ ID NO: 118 - DNA, 729 bp, Pestalotiopsis fici
atgccagatcagcagaaatatctgaacaaactgaatggggatcacgtcctcatcattggtggctcctcaggaattgggcatgcgatagccgaagcttgccttaaacatggctgcattgtcactatttcggcatcctcggcattgagcgccaagaatgcccacaaacgccttaaagaatcgtatccgtctgcggcaaacagaatcacctcccttgcgtgcaatcttggcagcacttccgacattgaagcgaatattgccaagctattccagcatgtgtccaagtcggggcttcttgaccacatcattttcaccgcaggcgaccagcttgctcagatgcccatccacgacgttactttgtcccgtattcaacatgctggttttggtgagtcttccattactcttacaagtggcgtcggatcgtacaagatgggcccggagggcgctgtggcaggagcatacgccgcgggtcttcacggaatggccagagcgttggctgttgacttgcaaccagtcagagtaaacgtcgtggctccaggtcccacggatacgccgctttggaggatgccagagcagcagaaaacggcacttatcgagatgcttaggacgaaacttgcaactggggagattggaagcaccgaaaatgttgcagaaacgtatttgggggttctcaaggactggaactgcactggtgctgtattaaacacgaacggaggatacttgttgttgtaa

SEQ ID NO: 119 - DNA, 1284 bp, Bipolaris oryzae
atggctcaaaacgttgcagcaaagcaggccgagaaggtccttggacacgatcaacagaaaaccgtgacgcaaacagatatctccaaccctgaccgcgatggaaagaagtatgcggacccgtctggcgagaagatgaaggcgttggtgtggatggggaagaacgacgtgcgtgttcaggacgtcagcaagcccaagctcctcgaggaccacgatgtactcgtcagagtcgctggctctactgtctgcggaagcgacgtgcatctcctgcacggcgtcattatccagacggaaaagggagatatcctcggccacgaattctgtggcgtcgtcgagcaagtcggatctaaagttactgagcgaaaagtcggagatcgcgttgtgaacagtttcgttgtctcgtgcggtgagtgtaggttttgcaagcagaaccttacgactgcttgtgataagacgaatgcgtctaccgtccatcagatgctgtatggcgagaagttggggggtatctttgggtattcgcattttgtaggcggatatgccggtgggcaggcggagtatgtgagggtaccgttgggcgaccagaatcttttgaagttgccggacagtattccttttgagaagggtctgtacctatctgacgtacttccgacttcctatcacagcgtgtctgacacgggtgtctatgaaggcgacagcgttgccatctggggtcttggacctatcggattcatggcatgcgtatgggcgttcaagaagggcgcaaagcgtgtcattggtatcgacaacaattggcgcactgagtttgcaaagaagaagattcctggcttggagactatcaactatgaagagctcaagaaccagtctattcccgccaagattcatgagatggtccccggaggcgtcgacgtttgcatcgaggctagcggcggagagtatatggtcaacgagtgcatttactcgaccaggaagtttggacgagttggtatcattgcagattacgttggatttacgaaccacttcaacattggtgcggttatggaacgtggtatccgactaatcgggtgcggacagagtcctgttcagaaatattggaaggaaatcctcgaaatgctggaaaagggtgaggttgatccgacaatcatggtgacccatcgcttcaagattgaggatattgcaaaggcctactatatgcaggagaagcgccagggtggcttactcaaatgttttgttgaaacgaagttctcggagccgcgggctgctggcaccccagagttgaaggaactctaa

SEQ ID NO: 120 - DNA, 1620 bp, Bipolaris oryzae
atgttctctctccgtattcgtcgtcccttgctatcgtcgctccgaacactcggggcttccccgctatcttcccgatcattctcaatcacagcttccatgtcttctaacgaccgagcaactctccaagacggagagaaggtgactctaggacaaggaagtaaagagactgccacatacgaagacctcaaagcctccgacgaggcgcatcaaatgcatggttttggtcatcccctcatgcaaaagggaccaagacagctcatcgtcttcgaatcgggcgacggggccgttctgaaagatgtcacgggaaaagagtatctggatgccttgggaggcattaccgtcgcccatcttggccacggtcgcaaggatctcgcgcaagttgctttcgagcagatgaccaagctggaagtctcttccaaccagcgtaacctgaccaacaacaatgcagttaaactctgcgagcgcctctctggcctcgcggctcaagctttcccagagaaaatgactggctcacgcgtgtacctcactaccggtggcggtgagggtattgaagctgcgtaccatcttgctttgcgctactggaataagtccgggcctctaggtactagctatggcggaggctacaagaaacagaaactgatttctttccgcaattgctaccatggcagcacgtttatccctgcgtctttgaagcccgagttttcagactatgggtggaagaggtggatggagggtcatggccgtgatgtgtatgagagcagcccgcataggatgttttgtaatatcgatccgccacatgagttgttctttgaaaggagcaagttgaagcatggagagaatgttgggcaggcggctgcacgggagctggaagaacggattctaaaagaaggcgccgataccgttgccgccttcgtttttgagcctgttcaaggcgacggtggcgctgtcgacatgcaccgcgacttcttcccactcgcggagcgaatttgcagaaagtatggaattttgatgattgcagatgagatcatgtcgtttgccaagacggggcactggttcggcatggagttgtacggcgtctgcccagatatcatggtcatcagtaagggtctgacatgtggttatctccctgccggagccgtgatttatcgtgacgacatctggaaaacagcattcaacaacatcagcactaagatgatgctgtcagatgtctggcagcatgactacacctggtccggacatccagtctgctctgccgttgctctccgcgcactcgacatcatcgaccaagagaacttgattgaactgtctgcgaagcgcggcagagagtttctcgatattctcaagtcggagctcgagggattgcatacggttcagcaagtccgtggaactggtgtcatgcttgggatcgatctcatttctgacatcgcaacggatattgagcaaaaggtgcttctagaatacggtattgtgctaagggcgagtaccaacaagcattgcttgcttctgacaccgctgtactctatgacggatgagcaatttaagaaagttgcagagtcgctgaggaaggttttgagaagttttgctacgctagaagtgaaccctggtctgtcactgggctga

SEQ ID NO: 121 - DNA, 1173 bp, Bipolaris oryzae
atgatgcttttcaaatggatatgtccagtggcgttgttagcagttcccgcatcttcctccatagtcgaacgagctacggtagatacgctacccctcctgactgcaatatccaaagatccagaactttctattttctatagtcttttcaatagtacaggaggcactagcggaattcccggtccaccgttcgaagagcgcttcaatgtcctcgcggatggacggaagtacacagcgtttgcacccgtcaactctgcatttgaggcgctgcaaccgggactagcagcagctttgaccgcaccggcatcctatgtgctcctcgaagccatcctgagaactcatattgctgaaggattagtgacgacaaaagaagtccgcagctcggaaaagcccgtgataagcatcgaaggcatacctctcaagtttgcgtccgagggtaacaccgttaccatcaacaaccaagccaaattagtttctgcacaaggtactgctgttggaaacggagcaatcttcaaaatcacctcaataatcgaccccttggtatcgatttttggaactgatgtgaccaaaaacggatctgacatcgcatccgcaagacgtcggcaagccaagaaaatcttagagtacgagttgcgaccctcgggaaccatcgcatcggccctatcttctctgccagatatctcgacatatgtagatctcttgaacgcaacatccccagccttcttcagccttcttaactcatctctgcccgctggcaagtacatttccatattcgctccgagtaacgcggctcttgaagctgtggggcaaggtgccaaggctattcagcctagcaaccagccatttacttcgtacttgcttgagtatccgttcatagatacgacgttggttggtagtgaaaagtcaattgttgggttcccggcggttgtgaggagagatggcaatggggctgttacgagtgtgaataatgcggctgtaaagggagagccgaagtgcgtgggaaatgctctccattcagtagctgcgatggtcacaaatgatgccactttcagtgtgcgggtcaggaatctggcccaaccgcgaaacgactgcttgtatctgggtcacgacgtggcggaggtggctgtgcctggtctgccttccgcggaagccttagctacatgtgccgcaccgtga

SEQ ID NO: 122 - DNA, 2328 bp, Bipolaris oryzae
atggcatcactgtctgttagtcaagtctctgcgttgattgctgcaggcaccactgcacgtaagtcaacctcggtgtatacagctgcttgcaagtcattaacgacctggaaagtgcaactactcttaccactggcaattccgctcatcctcatcgctttcatcaacaagcggcacgatcaagtacagcagactgctgtcacatggtccgcgctcagtcgaaccctccactcaacatactggccgacgattctcaactcggactcgtcagcgagtgcgaatgtgaaccctgcggttgtcgccgcagtctacttgggcatcttcacaacggttttagtcgctgtgaccgccgtcatcacgccccttggtctttatgatgcaatggtgtctagcaaacctcaaaggctgcctttcagctatgcgtcagacctgtcacccttcgggtatggaagtcttcctagaaatgatatgggattcagtcgtatctgtggaagccctcaaggatcaatgagttgtcctcgctcaaacttctctgtcacccgagacggctccattgacaataatggcacactcacctggaactggacagatggctactactacaccaacatctctttggagacacagaacctatgggaaagtggcctagtaacaatgcaaaagagtgtgtctagtattttcgacatccagtggcgttcctatgaaatcagacagcagaatttatcaagtatgttcgcttactacaatgatacatcttcatctaccgagaagtactacgacaacggatctccatacttagtgggaggttaccgaacgatacaaggcttgcttccaagcaatggattcaggatcgtcgaagggctggtggtcgatttggaaagaggtggaattggttttcgtaatcacaccattccctctcagccttctcatgaagttatatggacagaagatattctgttcgttgtgcccgaaacaagttgcgttgataacaatctaacgattgattacgatcttaaagaagacgatacaagccatacattgggatctggtggcatcctacggctgacagatcgtggcggattcgcgaatctgaacagtacggtcaatctggaaggcattcaaaccatgaacagctcacaagaccgcatctatcttcatgctagagcactgtatgcagccgggtttagcaacgcattgaccatgatctatatgaatttgacgaacgaacagcacggcctgggagaattcaggatgtacgaacaagcaccagtcgggatatcatacattcttgaagatgagtcgaaaacatctacatacagcggagatggtgggaaagtagccaattccatcccgaaaccagggagaattgctcttcataggcttggtcaacatttagatctcccttcttcagccaacatcgccagcaaccacacgttccttatcaatcacaatcagatatacacgaaccctcataacgtcacaactgatcttttcaaatacttcgggttgctagacctgcatgtcatcaatgtgacggaaaagagctatcctaacacatcatccatgccgatttggggagtggaaaactctggcatgacttatgggaatataacaccattttgggttgtagaactcacgatgaacataccgggagcaagcttttatagcaccatcatgcggtatatctacggagacctgttaggaggctcatcaatttcacccgcggagactcatgactactcagggtatggtcaatttgctctatatcaacggtggcttgaacttgggcggacagcaacactatctgcagacattatcaacctgatatggacagacattgctgcaaacgctgtagttggtactcgatcctggttatccaagtcgccgggttcagacacatctggatctcgagaccagagcagtccgcgtgaggtgcccaacgtcactctgctgcaacgaaagacgaagtaccatatcgcctacgcggtaccagcaatgttgttactgttgctggcactcgtcataagtgtcgctacagccatactactgcttctacagcgcactgggttgaatcgcatgagatggttcctcaaccaaacctcactgggacgcaattttacagcgcttttatacccagaagtcagctcacagcagtcttcgcagaaaatatgggcgaagaatgatgcacatagagtaataactgtggatctggataaaccgtacgctgacaaccaggcagacagtcaaacgagctcccagtccaaaggagacgtggcggtctcgcagcgtttgatgagtgagaatggaactgagcatccggaacaacagtag

SEQ ID NO: 123 - DNA, 855 bp, Bipolaris oryzae
atgaagattctttgccttcacggacgaggctctaacaatgagatcttccgcatgcaaacggctcccatccgtgcagcactagaagattttgagtgggtcttcgtccaaggcaccgtccgccacaccgaaggaaactggtctctacacacgtccgacttttctaagctccctctatacacatactacaacccgttcgacccccaatctatcatacaaactcatgaagagctcctcgacatcatacggagccatggtcccttcgatggtgtttttgcctactctggcggagcagcactagcagctgagctcctcatcgaagctgctcgttctgaatcagctgttgagcctctatttcgctttgccgtcttcgtgaacggcgcatcgccactacgcgtctttaaagtcgatgatgtagacacggtgagcggtcacgttgacgtctcgcaaacattccaacaggcaaaagaaatgtttctccgacctagcgcgctgcgacataagcctggtgtcagcgaagaggatcaggtggatcataagaagttgctaggactcttgagcagattagaagggaaaatgatggcggatggtactgcctttttgagcgacggtacatatgggctatgtcggtgggagcaaaacaagttgcaacctgcattgattgaaattccgactcttcatgtgaggagcacggcggaagatcacacggatccgcatcatggaaaacatctggtggagctgtgtgatcagtttgatgtcgaggagattcatcacgaatttggacatgattttcctaggggaagacagttgatgaagcagatagcggatgcgatcagagacatggctgagttggcgtga

SEQ ID NO: 124 - DNA, 1752 bp, Bipolaris oryzae
atggcacaagattcacgaccttggtggcaaactgctatcggttaccaaatatggccggcatctttcaaagattcgaatagtgacggcataggcgacctcaatggagttctcagcaaactcgactatctcaaatcgttggaagtcgatctcatctggttttctcccgtttatgattcgcccaacagagatatgggatatgatgtctccgactacgaatccattcacccacagtatggcaccattgccgacatggaaaacctcatcaaagaggccaagaaacgtgacatcaaaatcgtcatggatatggtcacaaatcattcatccgacaaacaccactggttcatagagagttgtaaatctcggtcagggccatacagcgatttttacatctggcgagatccaaaatatgatagcgaaggcaatcgacaaccgccaaataattggcgcacagggtcgcggtatggaaagagtacatggaagtacgttgaagcaagagatcagtactatttctgctttggaactacttatcagccaaacttgaattggttctgcgacgacttgagacgcgcagtatatgacagcgcggtgaaattttggttggagaagggcgtggatgggttccggatggatctggttgggctatactggaaagatccgacatatcctgatgcaaaggaagtttatcctggagaagcgctgcaaccactcgacggatcgcggtgcttgaacggcgaaaaggttcatgtctggctaaaagagctgaaggaaagaatcgtacaggactttggagaggacatcgtgttgattggggaacttccctccacggaccgagagacattcctacgatacatatctcctgaatcaaaagaactagagatggctctcgatacagatatcttcattgtgggtaatgaatggacagatggtttgtacgagctcaaaaagccagagctaccactattcaaagatgccgtcctgaagacgcagagccttctcgacgatggaggctggcctactgcattcctcgagaaccacgatttcgctcgcagtgtatcccgttttgggccaggtgagggggtctatcgcgaagctgccgcaaggatgcttgctctcatggctgcgaccctttccggaacctttttcatctaccagggtcaggagattggaatgaccaacgtcccatcacattgggggcgagatgacttcaaagacaacgccgacctcgaacatatcgaagatattgatccaaccaaagacgctgaggcggtggagaagtcaattgatgcgcttactacctgggggcgagataacggaagaacgccagtccagtggtcagacaaagagcatgctggatttagtgacgtgaaaccctggatcaaggtcatcgacaactacactcacataaatgtcgaggagcagcttggaaacccgaacagcatacgttctttctgggtgaagatgatgcagatgaggaaagagatgtttgatgtgttagcttgcgggctttttcgtcttgttgacagggacaaccccggtgtgttctcgtatacgaaaacaaccactgatgaaaagaccgagatgctagtggtattgaacttctcgagcgaggaagctcgggctccgacgcaaatcgggaaagatctaatgcatctcgtttgcacgacagctgcggcatcgacggagactggcttggatgaagtcacattgcagccatgggagggtcgcttgtatcgattggcaccgaagttgtag

SEQ ID NO: 125 - DNA, 1122 bp, Bipolaris oryzae
atgcaattcactgcggcaatattttgcatacttctcgccgtcttaggcttcaaatctttacacctcttcgcgacatccaatggattgttagggcacctggagcgcataatcacgaacaagtctaccccggcgggaaaacctctacgtaattggaccactggcggccgtttcccacggatcgatcttcaactcaatgcggttgctacgttccttctactctcctgtgaagattactcagagccagatgtgaatcttgtaggcttttggtttgatctatcatggggtccttcgtgggttctgattgtattggagagcttcagggagtacagtcgaagccgactgatgtcttggattgcaatcccagggctcttcatattcaatcagtcacacgctgtgtttacttccctttatctggcaatcagattgcttgttgcagttccggcgaccactgaagaaagcctgatggttgataacatccatctccatgcgattccctggagtttcttattaggatatcttctgccaatatctctcatggcgctgcctggaatatccatttataatcttaacacacagcacatgctcacctcattttatcagcagtggcatctttacatcagtctggtccatgttctactggtgacattgtggacctatacaggatcgatgggcagactggaagacgaaaactccaaggcctcattgtccgcggtcaggccggtttacgctttagccttctctatggcggtcatctcagtttgggttcccatccttgtctccttcgtcatccgtgcactacatcgaatccgcaaagcacatccatctagccaaaagaatcttcacatttccagtatattcatcccaccctctccatggagtaatatgaaatgtaaaaatgcatttgagggaggaaaatggcttctccaatgggacggcatagtaggaggactcagtaccgcagtttgggcaatcgctttatatgctgaagctcgcagtgcggtcgagccacaggagggattagggtcattttgcacgaggcttatatggtatatggtcttaggcgggccaattggtgttgcgacaggagctttgtgggaaagagacacgctcttgctgcagtga

SEQ ID NO: 126 - DNA, 1578 bp, Bipolaris oryzae
atggtcctcaaaacccagtggcaatacccaaaggatctgcttggattgctttctctcatcataggactgatcgtggcaacgatcctttttacctattccatctcctacatttacagcttccaaagatccgggcacgaaggatctgagccgcctttactgccctattggatcccgtactttcaacatctgcctgcattccttctagacccggcaagcctctatgaacgtggtagagagtacttctcagggaaacccttcactctcttactagccgggaccaagttttatgtcttttactcccccgaatctgtcagccatgtcttcagtcggtctcgattgttcactttcgagcccgtcatggcaagcatgatggaaaatgctgttgatcttccacctccagatcgacccaaattcgtttcatcgacagcggaaggaaaagatagcaaattcctggccgaaaaccacaacatttggacacgcaatctttcggggaaacgcctccatgacatcatggaaatctatatgtcggtgctccctactgttttggagtcgaacatcgatctttcgagtgacaagtggcaaaaaaagagcttgtacccatttcttaggaaaatcatcttcgagaccagtgtacagactttttttggtcctcgtttgatacacttctggcccactatgtgggacgactggagaagattcgatgatgctacgtacattggtgtacgatcgaacttaatattcaacttacagcccaagacccataaagcacgcgaaaggatgttccgagcatttgagcgctggctagatgctgctggaaatgatgagtggaaagacacggataacgtgtggtgtgagaaatggggtctccgtatgaattgggagagggatgtacttggcaggcaatgtggctttacgaaaagaggaagggcatgcttgcaggcaagctttctttttgtaatcgtaaccaacgctgccccaatggctacttggtttgcatactgtgctgcatgcaacccgtctcgtctagccgagtaccgtgacgccgccacacctttcatgctttctccctcgaccctctcaggctcagcttcaacgcctcactttgatcttccagctctcatcaaaaacccgtttgttcagtccctctggctggaagcattgcgcctaggaactatatctgcagccgcacgagttgtaacccgggaaaccaccctggaaggttatcttcttcgagcagggtcggtcatcttgatgccagtgcatttaatgcattctggtgtagaattcccagaggcaaagaaattccaaccagatcgatggctagacgtagacgaagagaaattgaaacgtcagaatatggtgatgcgcccttttggagggggcacaagtttatgttcaggcagatatgtggcggagatggagattgttggcgttgcgagtgtgctgctggagatgctcgacctgaaatttgaagaaatactttcagagaatcagtgggagttcaatcccagaagtatcggtgtcatggcgccaaagaaggacgttctagtctggataaggcgaagagagaagatgtag

SEQ ID NO: 127 - DNA, 7965 bp, Bipolaris oryzae
atgccggtgtcatttgttgagcctgcttcagcagcagaacctttagccattgttggtcttgcaacccgcttcccgcaagaagcctataacacagaaaaactatggcagtttttactggcgaagagatgtgcccatacaccaattcccgaagaccggatgggcccaggacattaccatcctgatcctgaacatggcggtacacatgctgtcgcagctgaccaaagtattttgcatttcccaggcggtcactttcttgccgaagatccagcatacttcgactcttcattctttggaatcacaaaaggcgaagccatgtcacttgaccctcaacaacgcgtggtactggagaatgtgtaccttgctcttgaaaacagcggtttcacattggagcaagtcgcaggatccaatacttcagtttacgtctctggcttcaaccacgaccacctagccatcctgaacagcgatccagagacaacgctgagacatcgcgtcactggccttaccaactcgatgcacagcaatcgtgtctcgtggttcttcgacctaaaaggaccaagtgtaactatcgatacagcgtgctcgagctccatggctgctttacatcttggtagccagagtctacgaacaggggagagcgatatgtctatcattactggagtaacaatcctcaattatcctggcgacgttaacggcatgtcgcatcaaggcttcctcagtcccgatggtcggtgttttagtttcgatcaccgcgctaacggctttgctcgtggagaaggagcaggcacagtaattgtaaagcgtcttagcgatgcccttcgtaacggtgatactatccgtgcagtcgttcgtggtacaggtatcaaccaagacggccgtactccaggcctgactcttccaagtagcgatgcacaggaaagattgataagaaccacatacgcatctgccggactaaactttgacgataccacattagtagaagcacatggtactggcacgaaacaaggagacgcgattgaagcccgcggaattgcacaggcattcaagtcgagacgaaaagataaaccgctttatctaggttcagtaaaagcgagtgtaggccacttggaaggtgccgctggtgttgcaggaatcatcaaaagtgtactggcactagaaaatggtgtcattccgccacaagccaattttgaaaaggcaaaccccaagattcccttcgagaaatggaatctttctattgccgataaggctgttccatggcctacgtcaggtctccgccgagtgtcaattaattctttcggcgtaggaggaacgaatgcacatgctatcctggatgatgcttaccactatctgaaagatcgtgagttgactggaaatcaccgcacagccattacagcaccttccatagagaagattgattctctgagccgggctgcggaagctcttatagccccttctgagcagctcagcgaaaccccacacttgaatggagacgagagtgctccacaacagaatgggacccacacaccatcgaaaaccaacggccatgctcacgctggtaatggtgttgacaaagcccataatctgagaagttgggtgtcggctgaacatattccaaagcctcctcaactcattggactctccgcctttgatgaagcaggcgtgtcacggaatgccgaaacacagctcgccttcttcaagtcccgttctacataccctccatccttcttaaacgactattctaatactttgaatcggcgttctcagttcagctggcgcagttttcttcttgctggagatgcttctgatatggttgaggcccttccaaacgttcatacaaaagctatccgagcccgcggacccatatctatcgcctacgtcttcacgggtcaaggagctcaatatgcagagatgagccgagaactcttcgtgtatcccgtattccgtgagagcataacacaagcaagtcagttctttacatctttgggcgcaacctggtctcttctcgacgaactgtcccacacaaaagaacaaagcaatgtcaatgagccttggttatcacagcccgcgtgtacagccgtccaggtggcattagtagatctgctaaggtcatgggacgtgaagccatcaagagctgtaggacacagttccggagagatagctgcagcctacgtttccggaaagctgactcgtgagtctgcatggcgtgtggcatactaccgaggagtagtatctgcgaaacaaagcgaacaaaagggcacgatgctggctgtcggtttgtccgaacatgatgcccggccatatgtggacgctttggctaagcaaggggttctggtggtcgcctgcagcaacagtccgagaaactgcactatctccggggatgagcatctggtctcaaaactgcacgacttgctacaagagaaggaaatctttgtgagaaagttgactatccaaaaagcgtaccactcgccgcacatggaccatgttgcgaaagagtatgccgcacttctggacggtatttcaccggatacatccatctcaccgaataccgtggaaatggtctcaacagtgaccggagctttcgttaccgaagaacttctagatgcagaacactgggtcaaaaacttggtttccccagttcgattttcggatggtttgacagcgacatgtttccgatccgcacaaaaaggccaggtttcactccgagttgatgctcagggaggcaaccattttgcggatgttgtgctggaactcggtcctcacggcgctctccaaagcgctatcaaagatatcctcgctactcagcccagcgggtcaagtataacctcgttccccgttttgaatcgatctaaacccgggcctgagacgctgttaactgcactgggacacatctggtctcgcggatatccaatcagccttcaaaaagttaacgaatgcactcagtctgagccaaatgccctactaactgacatacctggctacacgttcaaccactctcaactcctctggtacgaaagccgtctgagtcgcaactaccggctccgcaaagcgcctcgccatgacctcttcggcgcaccagtaccagattggaacaaagagcgccctcagtggagaaacgtacttcgactgaacgaacagccctggctgcgtgatcacattgttacaaactcccatgtctatccgggtgtgggttacctcatcatggctatcgaagcaatccagcagatcgctgatgaaggtctcgaaatcacttccttccgcctaagagacatatctatcaaacgtgcaatgattgttccggatagtaaagacgggctggaagtaatgctctcaatgaaccgggtggacgaatccagcataacagtctcaaacacatggcgccgattccaaatctcgtcttacaatcctgctggcgatgactggatcgagcattgtacaggatacattgctgtggaatatgctacaatcactggtccagttgacgatgggctagaagctcgagaggagtcagccagaagacgccgagaattacaagatgccgagcacaaatgtcaggcatcgtttgacatgttccgtgcgtacgagaatatggccacagtaggacttcaatttggcccattgttccgcaatgggtcagacgctaggggcactggtgatcaaggcggagcagtcattgggcgagtgacagtgccggatatcgcagcgtcaatgcccaggcagcacgcatcgccacatctgatacatcctgctacgtttgacagcatgatacacttcgcccttgccgctatcatggatctcttcggtgccacaagtctggagaacccggcagttccaacattcatcaaggatgtctggctatcagcagacctgaacccgctgcctggccacaagtacaaagtacatggtcgaactgagcgagttgctttcgagaagtatgacaacgacgtacttgtgtgggacgaggaaactggagatgcaagaatctcagtcaccggtattcgcgccacaccactcgactctgccgatcagcgagcagcaactagcagagaattgtgccacgaggtcaagtggcccgtttatctcgagacaatctctcaagcagacttggttccagaggaacgccccgtgggatccgacagtctgacagccgaatgggtacaccggttgcaactagccactctctgcctcgtccacgacgcactggacgagtatcgaaaagcccccaaggctctccaaggtcatcttcaaaattacttcaactggctagagcaactcgaacactggacgaaagaagacaaaatctcatcagtcccacgctccgacttcgaagccattcgtcacaacgacgccgccaaaaccaacatctatacccaaattcaagcctacaaagccgaaggccgtctagcctaccgcatgggttcaaacatagtttccgttctccgcggcgaaaccgatcccctccaactcatgttcggtcaggacgacatcctcgaccaagtctacgccgacctcgtgcgccttggcgatctccctgagctcctatccaaatacctgcacatcctcggtgaaaaccggaccaacctacgcgttctcgaagtcggcgctggaaccggatcgtccaccgaagctgtgatcaggaaccttgccccggtatctgaagacggccagctgttgcaatctagcgtgctgcaatacacctatacggatatctcgtctgccttcttcgataaggcgcgcgagaaattcaaggcgtggaattccatctttgagtacaaggtgctacatgctgagaaggatgttgagagccagggatttcaggccggaacttacgacgttgtcgttgcgcagaatgttattcatgcgactgaggatttgcattctacgctgtcaaatttgaggaagttgcttaagcctggtggacgaattttgatccaagagggtatgaggcaggactacttctggtcagcactggcgtttgggcagctgagtggttggtggctctcgaaagaggaaacgaggaagtggagtccgttcgcgtcaaaggaccagtgggcaacgatcttgagtggagctggctttgatggggttgagttggagttgaaagatgcccagattgatgtgtcgcatacgcagagtattcttgtgtcacgtgctgttgagcagaatgcggcgttggaagtgcaaaagggcagagctgttatcattgtacccgaatcattggacaaggatttgatctcagggctgcagcaggaattggagaaaacacttcagagtggaagcatctccatcgcctcaatccgcgagctgaaagaccaagatttgagccagactctatgcgtctcactcctggaactgaacagccctgttctctccaccctgacttcagaagagtacgaaggcgtccgaaaggtacttacagaatgccacgccgttctctgggtcacaggtgacatgctagaaacccccgaaaacagcatggccctcggtcttatccgcaccatacgatgggaacgagacctcgacgacgcaaacctcgtcaccctatccatcacaaaccccaagcccaacacacccaaccttatcgaatgtataagcaagctcactaccctccaattcactaaccctctccccaaagaagaaaagcagggcgaatacatcttcaaagccggatccttcttcaccagccgcctccactcaagcaccacgggaaaccgcttccttgcctcccaattcagcactccccagcccgttcccacagcctggaaagacgctggaagaccagtcaaactatcctctgcctcacccggacagctagatcgcctccaatgggttaccgaccccgtctacaccacacccctagaccccacacacgtcgagatcgaaatcaaagccatgggcctcaacttccgcgatctgatgatcgcaatgggtgagcatatggcttacagcatcgggtgtgaagccgctggtgtcatttctcgtgtcggttcgcaagtcactgacgtcgcggttggagatcgcgtcacgtacatcactggattggatcatgtcggttgtttccacacatttgggcgggtggaccagtcggtcgtgacaaagattcctgattcgctaagcttcagtgatgcggctggactaccggctgtgtatgttactgtgttgtatgcactgagagatgtggcgaggttggcaaagggggagaaggtgctgattcatgctgcggcgggaggtgtaggacaggcgtcgattaactatgcgaagagtgttggggcagagatctttgctacttgttcgacgcctgagaagagagatgtgctcgtgcaaaactacggtatcccggaagatcacattttctcgagtcgagacttgagtttcgcaaagggcatcctgcgagtgactggcgggtatggagtcgatgtggttctcaattcacttgctggagatgctttgagatgctcctgggaacttctcgcacccttcggtcgcttcattgagatcggaaagaaggacattcaagccaattccaggatcgagcttagacctcttctgcgaggcacttccatgacttgcgtcgacttggttacaatgatgaagtgtcggccacaactagtcaagcagctcactgacgacacagttcgcctttggagcgagggcgttgtcaaaaccgcaaaaccaacaaccgtttccccactttcgaagctggttgaaggctttcagactctacagtctggtcgtggaactggtaagatggtgttcgtcccacacgatgacgatattgtcccgatcgtgccggagcagcaaaccccattctacttcaagccagacgcaacatacgtcctgagcggtggactgggaggattgggacgaagtattgcaagatggatggtgaacaggggtgctcgcaacctattgttcctatcgcgcagtggcaagatcactccagccgttgccgagatggaaaagcagctggtcgagcaaaaatgtcaggtccgcattgaaaaatgcgacgtcactgattcagccgatcttgagagggtcctgaaggaatgcgagtcatctttgccacccatcaagggcgtcattcagggagctatgcaactctcagactccatcttcgaaaacatgacctacgaaaactacatgtccgccataaaccccaaagtactcggctcctggaacctccacgagcacctccccaaagacctcgaccacttcgtcctcctctcctccgcaaccggtatcctcgggaaccgaggccaggccaactatgccgcaggaaacacctaccaagatgccctcgcagcgtaccgccgctcgcaaggtctcacagcctccaccatcgacgtcggtgcaatcctctccgtcggctacgtcgccgaaaactcctcgcgtgtggccatcaacaaaggcgtaagcgtggagctcgagcagatccgtgaagaagaactacacgcgattctcgaatacagcatcgatccacgccagaatccccctgcacaaatcgttacaggtttggctaacagagacaaataccggcacaagggaatgccgacgccgtcgttcatgagtttcccactgtttgctcatctgaatagtgagacattgactggcgcggcgtcgtctgagagcaccgagattcctgtcgaggccttgcttgctcagacaaagacattggatgaagcagctgacatcattacagcggcggtgaagggcaaactggcgagtttgctgtcggtagcagcggcagatatcgatgaggacaagtcgataagcgcaaacggtattgattcgctagtggctatagagttcaggacgttccttgcgagggaggtcaaggcggatgtgcccatgttggatgttatggggacttcgacaattaaggtgttgtgtaagaagattgctacattgagtcgcgctgtagatgtcaagcaagacgagaagagtgtttcatcaccagttggaacaccatag

SEQ ID NO: 128 - DNA, 789 bp, Stachybotrys chartarum
atgggcgatgcatcaattctccattctgccaatgccctcatctttgggggtaacggcaaaacggcccgtcacttgactcgtatcctccggactgccgaaaccccgcacgctgtctacagcgtcattcgtaacccagaccaaatcccagacttggaggcgattggggcaaaccccattgttcaggacatctcaaccggcaccgaagcagacttcgtcaagatcatcgaggcgacccggcccgacgtcgtggtatgggcagctggtggcaaggatcccaagtcggccgaggctgtggaccgggacggggctatccgcgccatggaggccctgtccaaggctgcggtgaagtctaagcggtacatcgtcctcagcgccctggacgtacgcgatcgagacaacaagcctgtcccagactggtacaccgaggcagacgagaagctcagcgaccgcatgtggggtatcatcggtcccatcctgcgggccaagttagccgccgacacagagcttagggtcggcaacgaaacccggaagcttgattacaccatcgtgagaccaggcggcttaggcgaggggccaggccaaggaaagattcgtgcaggcaaagtaggaaccatgggcatgatttcccgagaggatgtagctggtgtcatctatgcggcgatgcaaaacaaaaagacccatgggcttgcattcgacatcctggggccgacggagggtagctatgcaattgaggatgctgtctcgcgggtagcagaaaagcacgaagatacctttgaaggctattattag

SEQ ID NO: 129 - DNA, 1419 bp, Stachybotrys chartarum
atggctcccggtcaggaacctcatccctcttggaaaagggtgtcggaaagcaaatgggagcaagcctatgggtttcaagatgcgttctatggtaggattgtcggaaaggctggtgaatcagcacttttccttgtcgcatcctcaatgagcattaggtttgccggcaatatttccgaggaggagcaggctatgagattgcgaaacgcatggatacagatgaggttcttgtaccccatcattgccgctgtcgcacatggaaagaagagggtttaccagtctcctgtggaaatggcggaggttcatgactgggcagcccggacgttcagagttatgggaaacgcaaccattactgatatatggcataacctggtcaagacggaacaaccaacaatgcactttattccgaaaacgcacgagctgttcttacaggcagaacacacccactttgacggtcgcgggggcctccatttttgggacgaattctttactctcttggtcaaccccaagccagtaaccattggccaagacttgggcaacctacctggacgatcagatgactacgtcaatacgaaagaaagaagaccaggccgcggagtcgacctagcaactcatatgcttcaggcgctagaagtgtcgccacccgagacaccgatttcctatcacctaaccaagacgaacaaagtccctggccatccacttcctcctatcaactcgcgtgccacattcaagttctctccacgagatacaagccgaatcaacgatgcatgcaaagatcgaaacctctcgcttgtcgcggtttggcatacggccgtcgtcctagcttcgcaagacgttcagcgtgaggccaacgcagagcctggttctgcgtattccacttgcgcaaacttcgacctgcgccgctactttaaagataatcatcgtcgggactctgacaagcgggcatacatcggaaatttccattgtgtactgccttacaaagtcaagcctaatggccgcacctttcttgaagttgcccaagacttgacttcattttatcgtttggggctgcaggaccagccggatatctgggctgcactgagaccgatgatggaaggcattggcgagtctttttccgatggaccaccagcagacacaacgcctgcagtgtcgagtctcggcgtccttgaccactttgtcaagcgaaattacagcgggccggcctgtgagtgctacattggcgacgcatggttcggtgtcacggctaccgggtcttggatggagagtttcatttggctattccaggggagcttggtgttgaatagttgcttcaacaggatttactatcttgacgaagaggttgatgcatttcacagcagggtcaggagccatatgatccaaggcttaggccttagtaacgtacttggagactccaggctctag

SEQ ID NO: 130 - DNA, 858 bp, Stachybotrys chartarum
atgactatcgaagcacctaaattacagcaaatccaggcctccgaagggcgtgacgccatccttcaggccgttcgtgcagacggggcagttatcattaaaggactgttcacaaccgaccaagtgaaccgattcaatgcagaggttcagccagctattgacaggcgtgggattggatcaaaccacacagaagaatgggtccaagactttttcggcgacaacacgaagcgcttgaatggcgtggttgcaattagcaaaacctttcgtcacgagatcctggaatgcgatttgattcacgaaatttgcgaagaaatctatctgaaggatgcaggcggttactggatgaactctgcccaagtcatcgacattggaccaggcagcaagcctcagccattgcatcgggaccaatggcagttcccgatattcactcattgcggtccaaatgcgcccgaagccagtatcaacttcgtcgtggcactgactgatttcaccgatgagaatggtgcaaccagagttatccccggcagccaccaatggagtgatttgtcgcaaaacggaacgcaagaagacactattccagccgagatggaagcaggtgacgcctgcttcatcactggaaaggtcgtacatgggggaggtgccaatcgtaccaaagacgcgattaggagagcaattactcttgttttccaatgctcctatctcaccccagaagaagcgtacccgttcatcctggacaaggagactgccaagtctcttactccgcgaggccagcgcatggttggattccgctcgcagttcctcaaagatagccctggagtatggaaacgggactacggcgagatggaggaagtttattgctag

SEQ ID NO: 131 - DNA, 996 bp, Stachybotrys chartarum
atggcggttgttgcagttccaggtggctcaggcgacctgggccgcgttatcacgcatgctctcttcgagaacggcaagcatgaggtttacatcatgtctagaaaacctgtggacgaaaaaacagtaccaagtcgtatatcgcccttgactggcagggcttactcgcccgtgattcaaaccgactactcggaagatgcccttgtcaagcagtttgcagagaaagggatcagcgcggtcatatgtgccttcatcatggattgcgattctgcatcggatgcccagtgtcacctgattcgtgccgctgaccgatctgagcatgtaaagcgattcatcccgtccgaattcaacgtcgaatatgatgccagcgattcagtcttaccttacccggagaaaaggtatcatctcgtcgctcgaaaggagctggaaaggaccactaccctggagtatgcctacatctacccaggcatgtttatggactacttcggaataccaggagtggaaagcagccttcgtccactctctttcttcatcgacccagcaaatgatctagcagtgttgccagatgatggagaagcgaagatgagcatgtcttttacaaccgatgctgcccggtacatagcgttagccttggacctagacaagtgggagcgcattatgacgacggccgtcagcaccgtcacgctaaatgagttggtccgtcttgttgagaagaagttgggccggaagctccaagttcactatcagcctgtcgcgaatctgcttgagcacaaggcgattgatctaccgacaaacgtggaaatagctaggctatatccgcagagatttccagaggggctagatcaactgagagggctaatcgccgatctcgaagcaggcgttgcacttggcgcctacgacttcaccaggctcgatggataccttgatcttgtcaaggcgtttgaagggaaagcacctccaccaaagcgcattgaagacttgattgaagaggcatggtaa

SEQ ID NO: 132 - DNA, 7536 bp, Stachybotrys chartarum
atgattgtatcgtcgaccgaagccggcctgtctagcggtacagtcaaagtaccccaactcatcgtcaataacagtccaactagcacgcaatccagtctatttgatctcatcgagcatgctggcatactacacagccagaagaccgccataatctgtggcacctcaacaattacccatggagagctcaacgtgcttgcaaatggctatgccggagtcttgacgcagcaaggagtcagaaagggcgaccttgtcgccgtggccctaaaccggtccattgaattggttgccgtgttgatggctatcctaaaaacaggagcagcctacgtgccaatagacccggcctttcctgcagaacgaatcatccaaatgatggatgatgcatgcccggaactattcataaccagcgccaacttactcgagaattgcatcttaacagcaagcctgcagtgcctgaccctggaggaggcacggcagagaatagacccgacctcatgtagcaacggagctacggcaagagtgacggaaaatgatcttgcctatgttatgtacacctcgggttccactggaaagccgaagggggtggaagtcagccacggaaatgtctgcaacctgctattgtccatgcagggaaaaccaggatgcagcgagaaagatcgcctgctagccattaccactattgcttttgacatggctgttctcgaactctacctaccccttgtttgcggagcaacaacagtcatcgctcaggagcacgagatcaaggacatggctgctctagtcagtcttatgggacaccacgaaattaccatcatgcaaggtacgccggcgatatggcagatgctgctcgacgcaggttggcaaggctgtccgcgactcgccaaaatcttctgcggcggtgaagcgctttctcgagcgctcgcagatcgcttgctgcattgcggcgatgagatatggaacatgtacggcccgaccgaagcaacagtatatgcaagcatctggaaagtccggcctgtggatgatattataatcgggaaccccataaagaattgctacctttatattctggatgatcagctgtcacccgtgccgtttggccaacctggtgagctttgtgttggaggagctggagtggcacgtggttaccgtaataattacgaactcagccgctcccgatttatcaaaaacccctttcacgacggcctcatgtaccgcacaggcgacgtcgctcgtcttgtggaatcaggcgaggtgaaggccatgggccgcgccgacgggcagatcaaaatccgaggctacaggatcgagccaggcgacatcgaagctgcgataacggctagggacgaaatatcaggagcagtggtgatctgccgtgacggtcgcctggtggcgtactatgtgcggaagatgctgcctcgtgaaaacggagttgctgaatcaacgacaacagcaccccttgagcagatgttacgtccgtggctggctgagcggctgccagcgtacatggtgccagcattctttgttgaaatgaacgcttttccggtcactatcaatgggaaaattgatcgcaaagctcttccagacccgataacagcaattcacatccaacccgccacagtcatgcccacaactgagctggaaagtcgtatcctcagcatctggtccaaggttcttggacacagccgtgtgggcctcaatgacaatttcttcgacattggaggggactcgttgcggattgtccgtgtccagaaagagcttcagaatattctgggccgcccggtttccacagccaagctttttgaacactatactgtcaaagccttggcggcgcatctcaatgctctctcaaaggtggatattccagacctcccgcagatccctgcagaggatattagcaggcaggatattgccgttgtatcaatggcgtgtaggctacctggtgacattgtcactccggaagggttctgggaatttcttgaaagtggtggggatgccatcgcggacacgcctgtaggacgttggggctgtgacacgtacgatcggtcgtactgccatcgaggcggattcatctcgtcggtttattctttcgacacttccttcttcggaatatcaccccgagaagctgcccggctggatccctcgcaatacatgatgcttgagacctgttgggaggccattgagcgagctggttatactgcccaagggctgcgtgacagctctacgggtgtctttattggtaccagcaatatcttgactcatcaaggtctcaatccgtcgacagtccgggatctcgcagatcttgatggatacacggtgactggctccgccgctggtaccatgtccggccgtatctcgtatcatttaggcctccaaggcccaacaatgacgattgacactgcttgctcctcctcactggtaacaactcatctggcctgcaacgcgctgcgtcttggcgaatgcgacatggccgtgtcaggaggaataagccttctgactaatcctggacttcacgtggaattcgatcacctccaaggcatgtcacccgacggtcgctgtcggtcgttttctgcggatgcgcagggaaccggatggtccgagggatcagtcgtcgtcctcttgaagcgactgtccgatgctcaacgcgacggcgacacgattcatgccgtcatacgcggcagcgccgtcaaccatgatggccgcagtgccagcttgacgactcccagcggacatgcacagcagcgacttgttcgtactgctctggctacggcccaactacagcctcatgacatcgactatgtagaggcgcatggcactggcactaagcttggtgatcctatagaagccacggcgctggccgaagtattcggtcccagtcgcgcggagccgaaaccactctacattggttccgttaaatccaatattggacacacgcaagcggctgctggtcttgtgggtttactgaaaatcgtcctagccatcaagaacagtttactgccacgaaccctacatgtcacagagcctactccagcggtcgactggcagggtgccaatatggcccccaacatgagtaaccgtgcgtggccgctggtagaagggcagccgcgtcgagctggtgttagtgctttcggtataggaggcaccaatgcccacatcatcctccaagaaccacccccgttgaaccacgtcgttgataaagagaagttgtcaaggcgggatgttggccctttgccaatacttctttcaggcgacacagacctggcattgcgcgcgcaagttgaaaagcttggtcgccacatctatctccaacagcacgatgacgatcttcgcgatatagcctactccctggcaaccacccgcacgcattttcgaaaacgaatcgttttagcggccacggacaaatcccagctcttgaaggagcttgacaatatggtcagccccggttctctgataatgcaggatactgacgacaatttccaccacaccaagatggccatgctcttcaccggtcaaggcagccagtggccgggaatgggaaaagccttgtcccaggtccatccgatctttcaccaagcattgttggaaattgcacaggaatttgacaaggagctggaggtgcctttgctcgatgtcatgtgggcacctcctggaagtgacctcgccatattgctcgaacgcaccgactatgctcaacctgctctttttgctttggaggtagcgttatggcgactttgggaggtgttgggcgtgaggcctgattttctatttggccacagcctgggcgaagttgtggctgctcacgtagcgggcgtttttgacatgcatgatgcttgtaggttagtggccgcacgtggtcggttgatgcagagtcacagcggtgatttcagcatggctgcgcttgaggcctctgcagccgagacagaagccgcaatcgggcagtttggttatgcagacgacgttggcgtggcactctataacacgccattccagacagtcatctccggcacaatgaacgaggtcgaaagtatcatgggctatttttccaagcaaggccgtaaggtcaggtccgtcgttataggacacgcctttcactcgcgtcaaatggatggtgttttggcagaattcctggccacagtcgagactctccggtttcatccgccgactttgaggatcatcagcagtctaaacggcaaattgatcgacgcagagcaggtgactcaagcgcagtactggataagacagattcgcgagcctgtccgcttcaccgaagggatacagaccttagctggccatggtgtcaacacatttctcgagttaggacctggccaggttctctgcggcctgggtgcagcatgtctttcaaacagcacgacgagtcacccactcacttggctaccatctattggtcacggcaagaatagtgcatcggttttccaagcaagcgtatcccagctacacactctgggcgcggacgtaatatggagagcttttttcgagcctcttggctgtcgccgcattctcctaccgacttatgctttccaacgcaactatcatgttcaccatagcctcgagagacagaattcacgctcgagaggacaccatgtgagcggtgccgggaggaggaacctgattgaccttagcccaccacccgatcgtagccgggtccaattcgacattgcatggcagctcatcggcccagcaaagaccttaccgcgcgggacttggggggttgtaacttcaactagcgatgagacgtgggcagaaagtgtcatcagccgcctgtcgcagaccgaattgaaactgcacccggttgacgcaccagaccaggcggaaaagctcagtggtctgctgtgtttgtgggacgcagatatgaattcaatttgcgaagtacaggatctgattgcaacagcgctgtcacagatccaaatggcagtcgaccttcaattctctcctcccattatctggattactcgccatgcggttggaactggcgttgaatccgacgaccatgcaatgagactgggagttggacctttgctctggggtttaatgagaacagcgcggactgagcatcctgagttgcaactacgtctgatcgatctcggtgtggactcatcgagcgccagcatcctatcagtactgccactacatgaggagcccgaatgtgccttacgtcaaggccgaattcttgttccacgtatgcgggatgtcgtgtcaaagctcgacccatccccacagaagcctcgcatgctgcgcacggatggcgcagtgctcatcacgggcggcttgggccatcttggggcgcgactagcacgatggctcgtcaacgattgtggtatcaatgacctggtcttgacctcccgccgggggatgcaaacttctggtgcagatgcactggtgaatcagctctccaagctgggcgcccgagtcactgtggtagtcggcgacatgtccagcttccaaagtgtcaagtcaatcatggctatgtttagcagtgaccgaccgttgagaggggtcgttcatgctgccggcgctgtagactcgggtgttatttcagcactgacacccgagcgatgcgagacgacaatccggccgaaggcatacggtgcctggttcctacatgaatcaacgcggaacatggacttggacctcttcttaatgatatcttctgtgtccggcatcatgggtctgccaggccttgcaaactacgcagcggctaacacattccttgatgccctggcacatctacgtcgtgctcaaggcttgccagggacatcggtagcatttggcaccttggctggtgatggaggcatggcatcgagacttggtcacaatacgcgctcctatctcgcgcattttggccttaatcctctgtcacttgatgtaggagtcgatgtgattgagaacgcgttggtcagcaaacgtgcgatgactgtagccgccgctctcgacttgccgcagctgcagcgttacctggaacagcagaacggcggaattcctcctcttcttgccttgctcttggtacaaggcgatactgtgacaaaatcgccattgcccaaacgccagagtctacgagatatactagccagagctgaggcggcacaacggccagggattatactcaacacagtccgtcaggttctcgccaaggcgctgggatttaccaaccctgatgatgtggaaacgaatcgttctttgaaagacctcggcattgattccctgattgcagtgcagattcgcaatcagctaacggccttgacaggcttaaggcttccggtcaacattgctttgatgcacccgaacctcggagcgctcggtcaatctctattgtcacaactagagaaagagaatggctctgcagctaccccgtctactctttcgttgaacatggcggctatacgtcaaggctgcgtggacaagagtttcaagtttggggcggggttgcgtgatcgtaaaacacctcagcgtcctaggccgccgaaggctgtattccttactggcacaacaggatttgttggcgccttcattcttaacaagctgcttaagcggggtgtcacttctcattgcttggtacgcgccgagagtgctgaaaagggcctgcagcggcttgtgagcactctgcaaacctttagtctttgggaggctggttttaaggagttgatcaagcctgtcgttggcgacattacccgcccttttctcggcatggaccggcaagcctttgaagacttgtcgaatcaagtcgactctatctgccattctggcgccctcgtggactggatgcggccacttgaggactatgttgggccaaacatcgtcagtgcccacgagattttgcggctcgcctcctgtggtcgtttcaaaggtgttcatctgatctctactatctcgactctaccgaagcacatgggtctagatctcaacgaaaacgacattgagtacggctatggcacatcgaagtacattgccgagaagatgatggcggcagcgcgttggcgcggtgcaagcacttacgtctatcgccttccttacgtcactgcttcggcggccactggtcatttccgccgcgatcgcggagacttcttgcacaattttaccactgggtgcctcgaaattggagagtttcctatgttagaagctgacttgtcctatgtgttgcctgtcgactatctggcagaatgcattgtggctaccatgacgcttgaagttgttaggaagggccaagagttcgatttcctgaattcacaggctttaagctgtaccgagtacttccggcttctcggaacagtcagtgacggtgagccgaagccgattgttgcattcggtgcttggaggcagcgggcgttggcatatgcttctgcaaaccctgggagttctctcgcacgtattggtggagttcttgaaacgtttacagaggaaaatgcgaactctttgtttgagggtcttcccgttggggagcacgtctttggaggtgaggattacccagcgccaaaggtcgacaatcgatttgtgcaacaatacctcagttgtatcagagggtcttaa

SEQ ID NO: 133 - DNA, 333 bp, Stachybotrys chartarum
atggccgagcatccagccttcacactagcgggcctatgcaagttggccgccggcggcagcttcggtttctaccgcacgcgctccaagccatccctcatcgctggcctgaccctaggcgctagcttcgcctgtgcaggatacctcctcaagaaaaacaaggactatggcgcagagcttgccttgggcagcagcgtcgccttgctcggagcgggagcccaaaggctgattgccacgcaggccaagtcgcgcccggccattggtcttaccatcgccggcgggctctcgacctactattaccagaagaaattcagggaatttcgtttcggggtctag

SEQ ID NO: 134 - DNA, 1800 bp, Stachybotrys chartarum
atggcgggctacgaacctgtcctgggcagcaagtccggcctcgtgaacatggcgcagagctcgcacacctctgtcgaggcgcggaatgcgccagacacccagcggcgcgagtggcgggcaaccttcttcagcaggctgccggttggcgagctgcttgcgattgcttgtgtcgcggccctctccggctccagtgttgctatcctcagagcttcgaacggcgtccctgtggacgattgggacgtcagcccagcagtttatctctccatcttgacgactgccatcggagttctcttgcgatttgctttccgtcgtggtgcaacaatcgcatggtggaaccaggcactggacaagtcgacccttactgatttacacgataccttcaacgatcgagagtcgctcttgtcggccctgcgacgagatccccgtaaatggacttttgtgcgctttgcgagcatcttcgtcaccctgatcatggccaacggcccactactccaacaggcatcttacgtagacttgagggaggagctttcctatcctcaagccacactgccgataaggagccagccgttggccaacctgacgaccatccccacggccgcaacatccatctaccagaccgagttcaccgacatcatcaaccagtactacaacagaaaccctatcactttggagccaggtatctgcgagggtacctgcaacgccacggtcgttgtggggggtttcgacaggaggtgcttgactaggcgtgtggacaccaccaccatgaacttgacagagggcgcaaccatgttctatattagccctaccatctcttcgacaaacgaatcgcactcgctcagcattgacgtctactatcgaagcacgtcagccgatattgatgaagacggcctcaacgagatcgcacggtcaggaggagacgcacctgttgtgaacagcctgacctggcatagttgcaaccttacacatgcctatcgtgcgctaaacatcaccattcagaacaccacgttggagctggacccaaccatgaatcctctcgacaaccataccgtcgagattctttctgggtctgacctggaatggaatggcccttatggttttggagttatgttgatcgataattttgtcagctccgttgcgtgggtcatcagtggcgagggtgatgattcaacaggagccccagagtttacaggccagacggcccgtacctacatcgatcgcggcattctcagcaacagctctgacagtgcgtttgaccgaagtatcttgacttggagagaccctatgcctgatatacttcgcgcggttgacgatctatctctccgctatgcagcagcacgtattcccggcacacccaggcgtgccctggagtacttggagtgggtagacgacaaccctgaaacacaagcctacatcgattcggtttctcggggacagaaccagacggtgcagttgacccaaagggtccaagtcgctgtatacgcgttccggcctcttactctttggctcagcgtggccttcacgatggcggccgtagtgggagttggggcgaccatgagaggattctggcatcttggcaggagggtgagcctgtcaccaatcgaggtgggcaaggcgttccgagccccattattcgctggcgtaggcagtaacatgccggcaagagacatcgtggagcaagcgggtgacttcagagtccagtacggggttctgagcagcgcagacagccaaagaggcttagagttggcaattgactctgaatcgtcaatcatggagccgaagaggggcgaatggtacgactag

SEQ ID NO: 135 - DNA, 2736 bp, Stachybotrys chartarum
atgtttattctcaagggttttgtcggccttgctgccgtgaccggaacgctcgggtttaacacccatgcccgtctcagcgttgataatggtacggatacggtagttccgaaccactacatcgttgaagcatccttgggtgccgatttggatggcttggtctctgaattgtcctctcatcgagagaccagagtcctcaaggtgttcagatccgacgtgttctcgggcgtggctgtagaatcgacaaacgaaaatttcgatacgctgcaacagaaatcggctgtttcccgagcttggaactcaaacaagatcaagctcgacatcatcaatgctcagaccttcaatgatgacatcgcagcttctgtctattccgtccataacatgactggtgtggacagactacatgaggcaggcataaagggaaacggtgccatcgttgctgttgtcgatacaggcattaattgggcacattcggatcttgggggtgggttcgggccaggcttcaaggtctctggtgggtatgatctagttggagacgttccctggccatgggagcaagacgagaaagtaccggacgatgaccccacagacacaaacggtcatggaacccacgtcgcgggtattgtcgcggctcaaggagaccaacttgttggtgtagcaccggaatccacattgctagcttacaaagtgttcggaaccgttgatgagactgacgacactaccctcatagaggcctttttaatggcatacgaggcaggggccgacataataacatgtagtgttggcggcttgggtggtttcagtaacaatgcctgggctgaggttgcatctcgcctggtagaacaaggtgtggtcgtcgtaatcgcagccggcaacaacggctacgacggtccctttttcgccagtaatggagctgcagggaagtacgtccttggcgtagcatccgttgagccttccgagcttgtagctccgccgtttcttgccacattcaaccttgacggtcagtcaaacaccacaacattggcctacatgctgggctgggatgaggcgttccccagaaacatgaccgattggccgattgtcccgctttccttcgacacaacagttccagactttgcttgccaacctctgcctgatgataccggcgacctgtcccaagtcataccccttgtccggcgcggggattgtggctacgagactcaacaaagcaatcttgaggcgttcggtgcgcgatatatcatgttttacaacacccatgagcgaacagaagagccatggtccttctaccaggacaattccatcctgagtctcattgaagctgaggccggggaagctatcatcaacacggtcaaagcgggaggtaacgtgactgccgacttttcaatcgaccccaacacaaattattacgggatacataactcagccggcgggcgtccgagtatctttacctcatggggcgggttgtatgatctcactcttaagcctgatctggcagctcccggtggcagcattttcagcacctatctgagaaacaactacgccgtcatgagcggcacgtcaatggcctgcccttacgtagccggtgtcgcggcattatacgtgggtcaatttggcggccgcaaggttcatggtgccgggtgggccaaggacttatcaatgcggctcatggcaagtggcaaggcagtcccttggtcggatggctacacggtggatgactacggttctctggcatctctgctgcaagttggtacagggttggttgatgctctcaaggttttggactacacgacgtcgctctcatgggccaaatttaacctcaacgatacacatttcttcagccgctatcatgaagtcgacatcacaaacaacggagacgagccggtgtcttaccgattttctattcaggatgctggtggctttgaggcttgggcgccgtacagcgaaacactgttcaatacgcctagactgaagatgaatcggcccgaggagctgacacccgtggagatggtgccagatgtcagctttcctcaaggatcattcattgttcaacctggccagacaagaaaggcgaagttcagttttcgataccccaactatccccaaggattagacaacttgtcagtctacagtggtaaagtcatcattacgagtagcaagggagaacatcttggagtcccctattttggaatcgcgtcaaatctgaaggatactctcaggaaggagaacttccgttcaatataccccgtcgttgaatcgggctggtcctacccgttccctaacatgacagagaagtcaagctggaccctcaacttaaccatctattctcaagactatccaaaactgtactctcgacacaactgggcaacacaggagcttcgctgggatatttttgaaaaaggatggacagagcgcaagtggacatatccgccagtggtaggcgagaacggctatgtcggaagcgttgcttactggtttaactcgccgtattactattattttgacccagagacagacgacgcgaactacaccgtctcttttccactgacagacgtcccgcgggtgtcgctcaatagtccgacggaagagtactggtggatgggtatgatggccaatggatcaaagattgtaccaggcgactacgtcatgagattcgggatcctgggtccttttggggttcagcgccatgcagacaactgggatacttacatccatcccttcacaattctccctttagaatga

SEQ ID NO: 136 - DNA, 1587 bp, Fusarium avenaceum
atggcagagtcgaaatctcagatgaacaatgatgattcgagctctgctgccttggatcgcctaccgactcatggcgataccgcgcagctggaatcacttgggttccatagtgagctccaaagaacattctccttaccctctatcgttggattgtgcctatgcctcatgagcacatgggaagcatgtgctgctgtgctcgttcagggacttgccagtggaggagctccatgtcttctctataacttcttagcatcctttgccggctcactcgccattggcgcatcacttgcagagatcgcttccatttatccgaccgctggagggcagtatcactgggtcacagccctagcacctgccagatacaagaagcctgctggctgggtcaccggttggatatccataggtggactaatcgcgctcacctcgtctcccgcgttcctcggtggcctgatgactcaaagcctcataatattaaattccgataactacctagggaccagatggcaagggatgcttttgtactgggcctttgtattttatgccgctgccatgaacgtatgggggcatcgattgctgcctaccgcaaactttatatcaggtgtcctccacggcctcttctttctcgtcaccctcattgttcttgccgccatgtcaaagaaaaacactgcgcacttcgtattcgccgaaacccagaatgaaacaggatggagtagctcggggatcgcctggttcgtcggcatgataagctctgtctatcctctcctcggctatgacgctgcatgccatctggcagaagaactgcccaatgctgcacgaaatgttcccatcgcgattatgggtagcatcggcatcaatggcatactcggactggcttttaccttggtactgcttttctcatgtggccccttggaaagcttacttcaaaccccaaccggattcccctttatacaactttatctcgatgcaaccaagtcgcatgttgctgcaactatccttactatctttatcataatgatggcccttgctggagctatagctggtcttacctcaacctctcgaacgctgtgggcatttgcgcgcgatgatgcaaccccattttcaaactttctgaacaccatggaacggaacgagcatgtccctaccagagctatctggactatcacagctttccagatcttacttggatttgtctatctaggcagttcaaccgcgttcaatgccatcttatccatggcgattatcagcatgtacctgtcatacctcctgcccattctcgccatgctcttcggaggtcgtgcggggcttgccaaggcggattatggtccgtttaaactcggccatgtccttggtactttgttgaatgtcgtgagtgctttttggattgtcctggtgattgtgtttagtgcattccccagtgctatgcctgtttcggcacagaatatgaactattcggctcttgtagttgcgggatggattctctgtggagttgtttattatcttctgtttgggcatctgaactttcggatgccgattgttggtgcaggtgttgttatgggtatacctctggctgcagttgagcacatttag

SEQ ID NO: 137 - DNA, 1515 bp, Fusarium avenaceum
atgttgagaacaatcatcaaaagagcgactgcccagtctaaccgcctttctccagcgcgttatcagcgatatggaggcacagcaacccagcccaagattcctctcataatcaacggccaacaggtgcaaacttctgaatcttcccccgtcatcagccctttaaccggcaaagaagtgtggtctttctcttgtgccagcaaggatcaggtgcacgaggctgtgcaaaatgcccacgatactttcagcgtctggtcccagaccaaggttgccacccgacgagatatcttgctcaaagccgctagtataatggaaaagagacgcgaagagcttggcgggtatatgcatcacgagattggagccaatcaattctaccaagactttattcttgggttgacaattgaggggttgaaggacacagctggcaggatagctggagctgtgcaaggatctaccccggagtcagcccatgaaggcatgaaggccttggtacagaaaaggccttatggagtcattcttggcattgccccctggaacgcacctttccatcttggactccgatctgttcttttcgctttagctgcaggaaatactgctattctgaaaggctccgaatttacacctcgttgttactgggcgatcgctgatgtcttgcgcgaggctggcctgccggacgggtgcttgaatctgatattccattcacctgccgccgctgccagtaccatcgataccctggtttctcacccacatatcaagaagatcaacttcacgggcagcaccaaggttgggaggattatctcttctaccgcagggaagtatctgaagccagttcttatggagcttggcgggaaggcgagtgcgattgtactcaaagatgctgatttggatcacgctgctcttcactgcgcccagggggctttcatcaatgccggccaaatctgcatgtcaacagagcgtatcctggttgatgaatccatctcctctgagttccaggaacggcttggtagtgcggttcgaaagcttttcggtactgcggatgatacccctgctgtcgtggctgcagcctcagcaacccgcaaccggggcctcattcaagacgctatatccaaaggcgcacagcccctcaagattttcgaggatgaacatgcccatgagacagatacaaaaatgagacctgtggtcctgggtaacattaataagaacatggacctctacgcaacagagtcgttcggccccagcgtgtctttgtttactttcaagacagaagaggaggctgtacaattggcaaacgacacggaatatggcttaaccgccgctatattctcaaaggacttaaggagggcattcaagctggctgatggcttggagtcaggagccgtacacattaattccatgaccgtacatgatgaatactccctgccccatggaggtgtaaagagtagtggatttggtcgtttcaacggttatcagggtttggacgagtttctttattacaagactgttacttggatggattga

SEQ ID NO: 138 - DNA, 1467 bp, Fusarium avenaceum
atgggcgtctctcaagagggttatttgtggacaccatccatttccaagcatggactggagacagactcggtcgtcaataactctgaacatattcgcgacaagtacgacgctgtagttatcggcgctgggttcgcgggactgatcgctgcgagagatctttccaaagtccacgggctgagcgtccttcttgtcgaagctcgggatcgcattggcggccgaacttggacaagccgtgagctagaagaggatatcgaaatgggtgggacttggatccattggaaccagcctcatgtttatagcgaacttgatcggtacggcctacaccacaagatcaagccgactctcgcatccgtctctcccgaaagagcattccataacttcggatcaacaatcgaaaatgtcgaaggagatgctcttattcgtgccgtcgaaaagacagcagaggatgtgttcgcgatagatggcttcaccagtcgcaccctcatgccttacccacatgaccctttccgaaaacccaacccatgggtaaactttgatcatcttactatcaaagacaggttggatcagatgaagctggctgtaaaagacagagaattattcgaatcttatatcagtcttttcggtctcaatgctgccgccgacaccggcttcaccgaggtgttgcgatggtactccctggcaggccattctatggcaggagtttatgagcttaccagtttttataagcttggcaatggaggaatgaccgagtttgccctggctgttcttggcgatagtcagtgtgatcggctgtttggtaccgaagtgtccaagatcgaccagagccaaggcaacgtggttattactgccaagaatgacagaattgttactgctactgccgttgtatctactatccctcttaatgtcctctcagatattcagttctcgcctccccttagctccctgcgttctgaagcagcccggcgtggacaaccaaacatgggcgcgaagctacatttcaagctgaaagatccagagccagtttggtttggaacagcttcagtgaacgacagtaccccatatctcttggcgtttgcggatcatactggaaccaaatcttcgggacccgacggcacttactgtgtagcagcagttcgtagcaacactctagacaacgtagagaatgttggccatgtgatcgaagaattcaacagaacattcaagccgacgagtagtgtacaggcctatcttgtacacgattgggccaaggacccttattccaaaggcttgtggagctgttgggcggcaggcagcatgtccaaatacctcccggaactccagaagccacatggtagagtagcttttgctagttctgattgggcgaatggctggcgaggttttatcgatggtgcgatcgagagcggaaagagagctgccagggatgccaaggggatagtcctcgctgcaaatgctactgcaaggctgtaa

SEQ ID NO: 139 - DNA, 228 bp, Fusarium avenaceum
atggtattcgagaccaggccccgatctgacgtcttcaaggtcgatgccacccctggcatccctcacgtttggtacaccgagatttttggcagtccaacaactgattcaattaagaatccactgactgctgcctatcttcgcatcgatagtggaccaccagtgactcctcccgtctatgcctttgatgaagctggtattgttattgaagatgtgtcacaggagaagtaa

SEQ ID NO: 140 - DNA, 768 bp, Fusarium avenaceum
atgacggtgcgacttgctggtgtcgatgagttactgtacagcatctcgcaggatgacagtgacgttgaactggcgcttcttgagctatgggatatgttgaaagaagatcgaggtgatgcgctgcggttaagcgacattataccacatgttttgctccgtgttggcggtgagcaggaatgctacgattttatcaagtggtgggctttccatggttcgaaaccaggcatcgacaaccgcaatttgccattctttaacaccaagggagccaatgcctgcgaatcccctcacgcactactccagacaggactcagccttagccatctcgttgcgctcacacttctcaaactacgactttttcttgacctggatgctatttccagttcctggtttgacaactcgtttggatttgacggtaacattgcctctatcgatcgacctctcggagaacttgcagaaggcattttcgaatcatccgactcaagtagggtcgagagactcgccagagacatccaaaaacagtatcttgacctgtgtaagcgggtgagtgctacgaactcttacttctgggagggtctagttacagatgagctgccttctgcgcctgggccttatgtatctgggtcccttgacgaggcccggctcgttctacaccactgtcgacgggcatgggacgcaagtgcagatgctctggttatggttgaagcttatgagacccaaaacgatggatatcccgatatttctggaaagatgacgtggcactgtagttga

SEQ ID NO: 141 - DNA, 1629 bp, Fusarium avenaceum
atgtcagccctcgtcttcaaggtccacgaccgtcttgttgtcaagaagcagtgcgctgatgggactaccgaaccagccacctttctcgacaatgactccatccgtcccacaccagttcaagaccggacttggacttcaattacatactcggctttctggttcgcggctaccgcaaatgtgagcaacttgtacgcggcttccaccggccagtctgctggcctcagcatgtgggaagctctgggttgctcattcggtggccagttggtcgctggttttctcatggtgctcaatggccgtgctggttcactataccgaattccctttcccgtcgcgtgtcgagcgagcttcggaacatggggtgcgttgtggccgaccttcaatcgtgctgtcatgtctattgtttggaacggtgtgaatgccgttcagggagcccagtgtctatacgtctttctccatgccatcttcccatccattgcaaacatcccagatatcatgggccccaagtctgctctcaactcggctcagatgctctgcttcttcctctactggatgataaattgcgcctttcttttcatccccgtaccgcgcatgaagaagcttgttcacatcaaggttggtgtgtatttcgcggccaccatcgccttcgtcgcctggacattgtcactatcaggcagcgtccgtaaaaccttagccgagccatctactgttaacggttcggaaaagtcctggttgatcctcaagttcttcttcctaggacttgccagctgtggcacctttatttccaatgcctctgacctgcaacgttatgcctctcggcccaatgatgttattgccggccaggtattcagcttcccaatgtcgaacttcttggttggcgtttttggaaacctgattgcggctgccagtaagagtatttttggcgaggtcgtctggaatccactcacgaccctggatatgctcatggagggcgatcgccatacatccgcaaatcgtgcgggatgtgctttgatctcgttcgcttatgtatactcaacagtcttctccgccattttcgagaactccattcccgccggaaacgacatagcagctctgatgcccaagtatatcacagtaaagcgtggcttcttcatctgtgcagctgtctttatcaacttcctgagctcgtaccaaatattcctcagcgctatttcaggtatcctgatctgcgattactacctcatcagacgtggtctcttcgacatccccatgctttattcggggcacaaagattctacctaccacttcttccacggttttaaccccagggcgtttctagtctatttgattgctatcgcacctaacttctatggattcctctcccagatgggtgtcaatgcaccattaggcatccagcgattttattacgtcgcctatcctgttggactgttgttagcgtttggaagcttttggctaataaacgtactctacccgacaaagaatatccctaaattgtcagggtggcaggagcctaaagattttgtggaggaccatgacgaaacctttactaacgttgtgattaattcttctgatacagcctcaggtgatcaggaaatgggcaacatcgagaagtctaccatgcagaagtattga

SEQ ID NO: 142 - DNA, 1104 bp, Fusarium avenaceum
atggctacgaccacagttgagaccacagccccagctgcggaatttacaacggtgcagttaatgacaccatatggacctgtctcccgtcgagtgcgctgcggcgagccacgcactccgacacttgatgaaatgcccattatagacctcagcaccctggatggagatgaaactgcacgcagagccctagccaccaagattaaagcagcggcagagaacacagggttcttctacgtctgtaaccacggaatcccccaagatttgatcgagggagctgtcgaacaggtcaaggccttctttgaccaatctttagaaaacaaggatcgggtcgcgttcgataaagccggcaagttctgtggttatcacgggattggaacaacgcaaatcaacaacaaggaaaccagagacaagaaggaaactttctctatgcgatatgacactcgtattgacccagcccatgatcgcattgatgatataaattccaacttcgatgccacagattacgtctgggatggtacaagtcatcttccgaacttccgccctgttctcactgagttctatcaaaaacggttgatgctggcacgcaaacttatccgcctctttgcacttgctctccagctaccagaagactactttgactctattaccaccactcccggagctgacgccgtgcacattcactaccctggcactgatgttagcgacacgggcaacaccaaggatgtcgacgtcggaattggatcacacacagacattcagtgcgtgacattgctctggcaggatatgtcaggtggtctgcaggttctctcagcggatgatgagtggctagacgcccggccaatcgagggaacactggtcatcaacattggtgacttcctacagaggctctctaacaaccggttcaaatcgactgtgcatcgtgtctacaaccggcaaaaggcatctcgttatgccatgcctttctttctagggttcaatccagatgcggtctgcgaggttgttccgacatgtactgatgaagatcatcctcctctctatgagccgatctcatgcggcaagtggcgtgactctcgtcttaagttggcggaaagtggaaaagtggcgtga

SEQ ID NO: 143 - DNA, 1503 bp, Fusarium avenaceum
atgcccccatctgacattgtgttcccgttgcatgaatttgacgactcacctatcaatcggtacacgcaacactggactctgcgatttgatgccgttctcgacacgaagaagctatgcgaagctctcacgcaccttctaagccagggcgactggagaaaattaggtggccggttacagtttaacaaggccggcaagcttgagattcatgcaccaagaacatatactcaagaacgtccggcatttcaatattcagaggagatcttcccagtcaaaaccacggatcatcctgtcgcgaagaacctccctagggcaagaggcaaagttgaactgtttcccggcatcacttcgcaattcaattccttgaccgttggccctggatggggacgggactttgatgaacacattcgtcacaaagagcccgtcattggcgtccacatagctctcttcaacgacgcaaccttgataagccttcgctgggttcacctggtatgcgatttcatgggaatcaaagctctggtcctggcttggtcaatggatctttacgggcgttacgatgatatccctccatttatgggcgcattcgacgaccctttgaaggatattggctcagtgccgcccgaggagccttatgctctggctgatatgaagctgagtcctgaagcgttcaaaaagacctacgacacatatttggagcatgtcgcggcatacccgataactgtgcgacgcatgatagtgctgccagactcagccttgcaaaagatcaagatgaacttcgtcggtgggcatggttcggataggcttgaagtcattccaaagggagcactattcaatggtcaatttgtaagcgacgctgacatcttatctgcttgggcggcgcgactctgctgtagtatccttcctgcggtggatcgtcccgtgcatataatgggcatgtatgaggcgagacactgtctaccagaaacatttcctcaaaataaggacaagccggattccagccccgtcttcatcgccaatgcaactttctcgacctcgaccaacaccacgctacgagcgcttcggcaacagccgctcgccagaaccgccctcttggtaagggagtccgtggcgaccttgaccaaggcccctcaggtgcatgcacagctacatcttttgcgagagtcatatgcgaaggacaaagagaacccagccgtatttgcggctgaggactctttcatcttggtcgtgtcgaacttcagcaaaatggcttttttcgactcaatcgacttctcccccgctgttatcacccccgctgaaggtggtcatggaaagtctccgggcaagctcgcttggcaccagtggacttcgctagagcacaccgtgcatgctcggaatatgttccaggtgggcggcaaagatggccagggcaatacgtggatgatgggactcttgccacccgagacctgggcgctggtagaggagcatttagccggtctctcagggcccaaggcgctaagcaagttgtag

SEQ ID NO: 144 - DNA, 9594 bp, Fusarium avenaceum
atgagccctccagccccgatcgccatcattggcgtcggctgtaagcttccaggtggagctaataacttagataacctttggcaacttctatctgagggtcgtaatggacagacagaaattcccaaagaccgctggaacgcggacgcgtggcacgacgcttacccagatgcgaagcagtccatggtaactaagcgcgggtattttctccaagatgacatctcccagtttgacgcgaagttctttggaatttccactgcggaagcaaactcaatggaccctcaacagcgtctctttcttatgacgacgtatgaggctctcgaagacgctggtattcccgtcgagacactacgtggctccaatactggtgtgtatgccagcatattcgagaggagttacgaccgcatgggtcacaaggacctgtcgacaattggcaggacacatttgaacgggacaggcgaatctatcctctcaaaccggatatcttactgctttgacctacgaggtccctgcatgacgattgatactggctgctctggaagtttggttggcttgcatcaagcttgccacagccttcgattgggcgagtcaaatctcgccttggttggtggctcacaactcgtcatacagccagacgttctaagcataatgagcggcatgggaatgctcaacccagatggaatatcctatgcgtttgactcaagaggcgccgggtatggacgcggtgaaggcgtcgctacaatagtcctcaagcgtctagataacgcacttaaagatggtgaccggatacacgctataattgctaattcgggcatgaatcaagacggcaaaacgcccggcctgaatacaccaagcggtgaagcacaagctgctctctcgctccgtgtgtaccaagaggctggactgaatcctgctgatacatcattcgtcgaggcccacggtactggaacacaagcaggcgaccgcgaagagatagcgtccataaataaggtcttctgcgaggactctggtaggacagatgacctctatatcggttcagtcaaaacaaacatcggccatcttgaggcaacatctggtattgccggcttattaaagtccatacttatccttaagcatggccagattcctgccaacctcaacttcatcaaaccaaagccgtccttgaagctctatgagaagaagataaagatccccagtgaacttacaaagctgccaacaccacgtaataatggacccgctcgagtatcagtcaattcctttggttacggaggaaccaattgtcacgttattcttgaggctccagattccaaacaccagcttaacgggagtacgaacgggacatcgtctcataagaataactcggaactgagtaatggagctaccaatggatcctcgaccgctcacgtggcttctttgaacggatctgcaactgctactgatgccgctatcactcatgactctattccacaactgtttgttctcagtgcatcaactgagaaggctttgtcgtcaacctctgagaatattaagcagtgggcaaatactcacccgctggagcctcagattctccgaagtctttcttacacgctaggtgcttgcaaatctgctctttcattccgccgagccatcgtcgtgtcgacatccgcggagttgctagaagagctagaccaaacagttcacccaaagagagcagctactcttgcacctctcagctttgtcttttctggacaaggtgcgcaatggcatgcgatgggacgtgagctcatcagctcctcacgatgcttccgagagtcaatagaggctatggacaacacaatccgccaggagggagggacatggagcctcattgacgagctggccaaggcggacaacgagtcacggattaacgaggctgagatttcccagcctgctaccacagctatccagattgcacttgtggatttgctcgacagcctttctataaggcccagccgggtagttggccacagctctggtgaagttgccgctgcctatgctgccggtgctctgagcagagacaacgccattattgttgcctatcatcgtggtgttgcctccttgaatgcgaaagcagcggctacagtgcctggttcgatgatggcagtcactctcggagaggccgaagcgcagcgatacattgaccagattaccactggaactatcagtgtagcctgtgtgaacagcccatcgagcagtacaatctcgggagatgtggctgcaattgatgagctcaaatcgttactcgacgctgagggaatctttgcacgcaaactcaaagtcgatactgcctatcactcgcatcacatgcggcgaattgcacaagattaccatgaagcgatgcgaaatatcgagtcttctgacgtacggagcggtgtcacattcttctcaagtgttagcggtacagtcaagtcatcaggattcggcgccgactactggaaagacaacttagtctctcaggtcaagttcagccaggcgttggctttgttgcgcgatgatcaattaaagaacgagccagggatggacacgagcgttttcatcgaaattggccctcattcagctttggcaggccctgctcgtcaaacactaacacaaccaggaagcgcaaagttcaaatttgaatatttgtctgccctggttcgtcataaagacgctgtacagacggtgttatctcttgccggcaagacttttgaactaggtctcaaggtcgatctggaggccgtactcaaaatgactgacgaagcagagcccgagattgtcagggatctaaaatcgtatccttgggatcttgctccgttttggcacgagtctagactcagcaaggctcatcgctttcgcaagtttgcaccacatgacttactcggtctactggacccggcgagcaccattcaagagccgcgttggcgataccacatcaacttggacgccctgccttggctgcgtgatcacgtagttgagggcttcacattatatcccggtgcaggatacttgaccatggctatcgaagcgatgaagcagcttgtgcagttgagagacgctcaacagtcgattgcaaagttcatcctccgcgatgtaaccatttcgaaatctattgtcctcaacgagtcggataatgacgagcaggctggcgaagttgaagtattactgagtatgtccacctcacgtcagtatgaaggcagtcgctgggagtcattccgaatctggtcatatgacaatgtcaatggttcatggtccgaacattgctcgggtgagatcacggtcgaatgtgacggcactgaggatgatgaggtaaacgggacaagagaagcggacctgcgcaaagaagagtcgatgcagctactcaacgatgcccggcaaagctgtgatttggagatgacaaaggccgagttctatgagtatgccaaacttaccggcaaccaatgggacggggctttcagtcccattgattctctgaagtatggcaacaaacaaggccttctagatatcatcattccagacgtggctactctgatgccatatcgctcattccgacctcatgtcattcacccaatcacccttgatgctgtccaccaactcagtggcatgctcttcaagaagtttgtgtcaaacgctccttgcgtgccgaccaagattgctcttctggaaattgacgccaatatttcggcaaaagctggcgatagtctgactgctgccatgcagatcgaaccagatggatcgaaggcatctacaggccagtcttgggtgtttcaacgagatggcgatggtgagctcagacccgtcattaaacttttggtcaacctaagagccattggcgaggcgcatcaagatgaaaaccggcctttcgttcaggataaggtaaaccgactggactggaacctcgacggagactttatgacagaaacgtcattctcccactttctttccaccacactgggcttggatgagaacatgacatacaactatgaaggcagcaaggtttctgctgtcaaagccgaggagagcttccgcacagctgatcaagcagcctctatctggattcgagatgctctgatccatattgaggctaacaacgttgagatcacgagccctcatctagtcaagtatcttggatggatgaagaagtgggtcaactctgactactacagcgagatcatgtcaggcttgagcatcgaggatgaagtcggcatattgcagcgcattgattctctcactgatgcacccgagctacaactgcttgcacgtgtcggtagagcccttcccagcatcctaagtggcacactcgaacccttgagcgtcatgcttgaggggaacctcctcatacgggcttacgagggtggaacttttagtggtgactatgaggctgcagttgcgtatcttcaacttctcaccttcaagaatccacgccttcgctttttggagattggtgctggtacaggaggctgcacaaagcgacttcttgaaggaattgttggccgcaatggcaggcaagacctcccaattgagcagtacacgtacacggacatatcaagtggcttctttgaggaggcccgcaggacattctccgactgggagtcttgcatggagttcaagacattggacgtggaaggagatcctctcaagcagggttaccagcccgaatcatatgacgttatcgtggcatcgaatgttctacatgcgacgaagcggatggatgtcacgatggagcatgtgcgaaagcttctacgacccggtggaagcctcatcctcgtggagaactcacctaagggcgcagtcattggcctcatctttggcacgctgtctggatggtgggctcatgaggatgaattcagagaggacactgctttgatgtacagggaacaatgggacacgatcctgtcgcggaatggctttggcggaattcatgttgcacgcaatagcatgatggtttccaaagctgtgcccttgttgaccaatgggcatgctgcgggaaacaacaaagttgttctcattaaagacaccgccgatgatgttattgacgagattgccaagcatatcaacgataattcgactgaggttgagataagtgagcgcagttgggatcaattggacgtcagcgaggacacgctctacttggtcattgatcgggctgagacacctctactcctcgaccctcgacctcaactctttacaacactcaatgctctccttgcctcgaaggccaaaatcctctgggtagtcactcaagatactcccgatcccgtgtccacagcatacaagggcgtggtgaatgctgttgttcgagtccttcgtcgtgaaagtggcaacactggatttgtcaccctcgacatccgtgatcctgctcctgacccaaaggtggccgggcaagtagtgtccgatatcttgagaaagtgtttttggccagacacctctgatcaaaagtctgtggaacctgaattcgcgtacgagaatggtcgagtgtcgattcctcgtgtgttgccagatacgaccttcttgaaatgggctcgaagcagctgggatgacccaacgactgcgactgagacagagactgctcttcatcaaggtgacagagccctcaaacttgaagttgctactcctggtttgcttagctccctccgattcgtggatggtgacttgttgcccgaattgggtgccggtgagattgaagtcaaagccgatgcctttggcgtcaattacaaggatgtctgtgtggccctgggacaaacgaactccggtaccgaaatggtcggtgaatttgctggtgtcgtgacagccgtcggccaagacatgaaagatctctatgaggttggagacagggtcatgggctttggtgctcagccatacagcaacctgtctcgcgtcaatggttaccatgcccacaagacacccggttcaatgagtagcattactgctgcttcgatgtcttatgcatatgtggcggcataccaatgcatcaagaacctggctcgccttgaacagggtcagtctatcctcatccattctgcatccggagctgttggtcaagcggcgatccaacttgcccaatccattgaagcagagatcttctgcacagttggaagccgtgagaaacggcaattccttgtgaatgagtacggcattccagaaagccacatttattccagccagaccggctcattcaaacaaagcatcatgcgtcttaccgctggagagggtgtagatgctgtgctcaacacatctacaggagagatgctcagagatagtcttgactgtgttaaaagcctgggcatctttattgagctggggaagagtgaaatgcaaaaggcctctcgtctaagcatggcatctttcgagaagtcaatcacgttcaacacctttgatttggtaactctggctgcacgaaagcctaagaagatataccaaatgcttggtgaaatcaccgaacttctcgattcggggatactgcgcccagttcagcccattaacgagtatcccatcgagcaggttgaggatgccttccgcctcgtgagtgcaagaaagcacataggaaaggttgttctcaaggcacagtcaacatcagtagtcaaatgcctgccagcaaagccgacgcctcttcgactccgcaaagatggcacttacatcatcgcaggaggtctcggcgatctcccctcgcggatctctcgctttttcgctgcccgcggagctggccatatcgtctccctttctcgacgcactatagacaaggagacgaggcggagacacgtggcagcagtggaagcgcatggtggcaaacttcacatcctgaagtgcgacatcacgaacgaggagcagatgagagaagctgtctcatattgtaatgggttacctcctgttagaggtgttgtgcaaggcgcgttggcgctgagagaccgaactttctctcaaatgactgttgacgagtggaagcagccgctccaacccaagattgttggaaccatcaatcttgacaggtttttcgccagcccagacttgtccttctttgtggcactatcatctatcgtgtctgtcattggcaagtctggtcagtcgaactacgcagccggtaacggtttccaagacgcctttgccagggctcatgccaaccacccgcacactcaatatgtttctctcaacatcggcgccgtctccattgatgcccatggcgctttggaggcaacccagaacgagaccgcaatcagtactatcagggcaagtctccgtcaaaacagtgtcatggatatctcgtttgacgagtttttcgcaaacttcgaatacatcatgaccgattctgctcgaaaggacggcctccaccagtccatccaagcagtaacgcgtcaatctatgatggaagccaatgacgcttatctcctcgataatcccgttttcagcttactaccaaaggcagtagagaaaaaggccactggcaccgctaaaaccgacaagatcgactttgcagaggcactggctggagtgaaaaccatggctgaggcggagcagctgatccaggacgcagcactcgccaagtttgctgtctttctcgacaggcctgtggaggagattcgagttgatcagtcgctagccacgattggactggactctctcgtcagtattgagttgaagaactggatggtgcgcacattccaggtcaatctgcagacatctgaattgagcggtgccggcagcatcacggctctcacggccacggttgcttcacgatctaagctgattcccgatgaggtccgccaatcacgcccgaaagaggatgctcctgtcaaacaagaatcagctgtgtcgaaacttgaacagtctcatactgatcatggcttctattgttgccgtacctgcaaggatttgcccagatacccgctcgtcgacctagacgaggccgtcaaagaccttctcaacagcgtgggtcacttctctcacactcgggatgaatacgccgagctcagtcgcaaagcgcatgctttggcagcaccaggtagtcttggtcgcagactctacaataagctgcgtgtcaaggctgatgatcccaacgttgagagttggatcgccgacctacttctcaaggcactgcatctcaagcgcagatacccgctggcaccgttcggtaatttcttgggcacacactttgacagcccgacacctcacacccaggcagagcgagcggcgctcctgactacaacgttgtacgaattcaaggccgatcgtgacgcgcacaagctggaacctgatttccttggtaccagggctaactgcgggcactcactgtcttggctgttcaacgctgtaagagagccaaacgtcgactgtgacaaaatgatgaggtacccagataatgagtacgttgccgtgttgcgaaggggtcatctcttcaaagtcccgctgaagcaaggagatgtgactatctcatatgacatgctcaaggcaacgtatcaggcaatcgttgattcggacttgaaggaccgctcctgggccggcatgttgaccactgacaatcgcgattcatggggtttgaaccgacagaagctactctcactggacagcagaaatacagtgtatttcgagacgattgaggcttctgtattcgtcatgtgtctcgacgacgatagccccatcacgcgcgcagaccgagtccactctggctacattggcgactccttcaaccgctggcacgacaaatgcgctcaacttattgtcaccgccaacgggcgttcggcaaccatcttcgagcactccatgatcgatctcatgacggtctctcagctttcccagcgactgcaaagtgccattaccacccatgactctggcaataccacagcaagtaacggtagctttgttatcgatgcaaatattctcaaggagattcccttggtgacgactgaggacattgatagtcacatcgagactctccgtcaagactaccttgccatcacatccacaaagcaatatgtcccccatctcgttaactcatttggcaaatcccttctgctgagccactccgcgcccatcaaggcgactgtcgacctaacaatccagctagccagtcgattatactttggctacttgccagccagttgggagacggtatcaacagcacatttccaccttggtcgtccagagattgtgcaagtggttctgaagtcagtcatggacttttgcgacgccgctcttgacgacgccgtgccacggagcgaggcacgcgcaaaactcctacaggcagcacgcgagtgtaatgcgcagatcgcaaagggaaccgagggacgcaactacttccggttgatggatgtgatcgaaaccatgtcgcaggatcagaaagacgaagagatcccagaactattctccgatccggtctggaagagaggctacccgcagctgattatgcaaacaatggtggaaacgaagctggcagaagatccgggcttcactatgccggatccagagtctgtgtggatgaactatactgtgtttgatgattcgcttgaagtgtgttttgttagtccatcgaagagtgcagagcgctttgcggcggctctggaccgagcagcagagattatgaaaaacattatctcatcaagggatgtgtag

SEQ ID NO: 145 - DNA, 2694 bp, Fusarium avenaceum
atggcatcgtctttcttagcactgtcgcaaacccttggaggcatcacacacaccaagatcagcgaactgggaaagcagcgcactatctatgaagcgcgaaaggataagatcctaggccaggccaatcaagaaaatgaccgagttgcaaaaatcaacctccttctagagggagtcgagagtctcaaccccgaaggattcaaaagccccgcaatcaagaacatcaaacactggctcagtcagtcaaaatatgatgtgtctgttccaagcgagttcatgcagtcacatgaagagctgctccggtcgcatctagaggtgccaagtcggaaactagcactgggccacctctacgctcggctcataaccgaatggatggattcctctgtcagtggacgcccaggttcagaagaagagtcttttgaggttttagatcgacaaaaagagaggctgcagcagttgtgcgacaagttcgagcgagtggtttttgagccgctggagaccgatgaagttgagattgacctctacctcaatgagctattccaaggcgaacaagatgatgagagttccaagtcacttaaagagcttagagatactatgagtgactcgtgtcgacggatctttggtgaaaaagcgccgttcgactccacgacgctcaagtggtgtatcaacgggttactcgctgaggacctgctgagcgatcagaaacaggccattcttcgagactttcttgaaaagcctgttgttttgggggagatctccgatgttctcaatatgcgattttccaatgtcgacagctgggaatgggatgctggggaacatggcattcctgttcttcctagacagcagttgaatggtaaatacagaatatggatggatgaggatgtgttgcaagcaatcctcattcactacattggtatccagtgttgcgttgatctcaagaaggctctaagtagctttatttcttccgcaaactctttctggaagtggaacactggaccgcagcctacccatgacgagatgcaccgtcgccggtattacatgtgcagaggagccactgcaagatcaaacaccaataccgagagacaagggcaatataaaagtacattcttcatgtcacaactgccggagactgttgaggccattgggtctgggggctatactgactcaccagaggagcaagacaactctaaaaagccaaacattaagcagcgcctgctgcaaacgctcgccaccgaggccatcatacacaagactttgagcggcgaagttgcattggtacagactgatctggagtggttcgccacgggcctgtcccattcaactatcttttccaccatgcgattcttcggctacactgaaggggccatctccttcttcaagaaggttcttgaggcacctctcaacgtgcagtcttccccagactctccattgacaggcagcccaagaatgcgccgtcgcggagtacccatggctcatgcaccggagaagcttctcggcgagcttgtactcttcgttatggatgttgtagtgaaccaacaggatggtatgctactttaccgacttcacgacgacctttggctatgcggcgagccacagcattgtaaaagggcttggattgctatgaaacagtatgcggagattctcggcctcacgttcaacctcagtaaaaccggttctgcgtacatcacagcggatggaaaggcgaaggatactgaggttgcaatcgctttgccgcaaggtccggtacgagttgggcatctatctgttgaccctaactcggggatctggaagatcgaccgcgagcaagtagagcaacacatgagacagctgaaaaagcaattaaacgaatgcaggagtgtactagagtgggttcaaacgtggaatagctgcatgggacgcttctttagccacacgtttggtgaaccggcccactgctttggcctacaacatgttgacagtatcctcgagacttaccagctgatgcaacaatttttattttcggaaggatcagattccatacagaacagtcatggagccgttaaccacgtcaagcatatgataaaagaccgattcggggccgatgtacccgatgccttcgtccatctacctgagcgtctgggaggactcggtttacggaatccattcgtgcccatactgactattcgggagagcattgcgaaaaggtcgccggcctcaatcattcaagagttctttgacgcagaaaaggagagatataagcgatacaaaaagcacttcgattcgctgccaagcgttgacagccgcatcgatgcagctgtcagggccacatggagtggagaaaccgttagctccgaaactttcaagaacctgctgtcgactgaggaactggagagcttcttcagcatgaacgattacacgaaatacagggagcttacgagctatgccctgtggcaggcttatctctccttgcagagcctgccgtccgctatcagcccggacatggactctgacgttgcgcagaccatcagccaggaattgggcgtcagtgccaatgatgcgggtagtaagattcaggaagctcgatgggcgttgcaaatgtatcgggatgggttgcgccgtgactatggagggttgcgtcttgtggacaaggaacatcttccgctgggtgtgttaacattgctacgtagtagagcagtgacatggaccatggttctctaa

SEQ ID NO: 146 - DNA, 1161 bp, Fusarium avenaceum
atggtttcctttaagatcctctctctcacaggcggcttactactggctaactttgccactgctcatcctggcgaaaaacatgaccacgagcacatcaagagacagatccaggcacgagatactatcgccaatattggtcagagatcattgaacgcatgctctggttccacgcatgccaacgccttgaaggcccggtccatttcacgtcgggcccgaaaggttcaagatctccgagagaaacttggtatcaagacatctcctagaaagcaccgccgagatgaagaggatattgttgcttgggaggcaattaatcacaacaaaaccggcatttcgaaaaatgatatgttcactcccctcgaaacagtctttggcgccaactccagttgtatcctatcccctgaggtcactgcaggcccatactatatcgtcggcgagtatctgcgttcgaacgttatcgaaaaggaacactgtgatggtgtccccctgttcctagaggttcaatacgttgacgtgtctacctgcggaggagtcccaaatttggctactgatgtctggaactgcaatgctacgggtgtttactctggcgtgagctcccaggctggcctcaacactacattcctccgtggcatccagatcagtgaccatgatggtgtagtccagtttgagaccatcttccctggacactacgaaggccgggccacacacacccaccttcttacccacgccaatacatcggtttcatctaacggcaccgttcaagtctggaacagtccagtctcccacatcggacagctcttctggcctgaagatctgcgcgaggaggttgaggctcttgcgccctacaacactaatactgtcgaagttacaaccaacgaagaggatatgtggtcgatcctccaggctgacgaatcttatgatccttttcctcagtatgtttatcttggcgatacggttgaccagggtatttttgcctggattcaaattggtatcaatactaccgcagaccatgcttcagacgagtattatggcgttgctggatttctagatagcaagggtggccatgccttggacagcggcattggtggtggccagggaggtggacctcctggtggtagtggaactcccccttcagggcagcccactcctaccccttcgtcctaa

SEQ ID NO: 147 - DNA, 1248 bp, Fusarium avenaceum
atgtcgtcgagaaagaatgtcatctttatcggaatgacgcaaaatggcaagagttccttaattcaacagatcttgaaatacgccaacgaggacgagatggcccgccgagtggcaattggtcaaggcaacatcgctcaaacccaaacgtgctctcaatacgatgtcgacattcctctgaaaacccacaggctccggcaaattaatggccctgaacatatgcaggagtatgaccgtacttatgtcactccgggtcaggacttcgagttcgacgacgccgacgagttcacatttggacacgatgtagaagattctggcgagctcctgtttctgcggctgatcgacacgcctggattgagtgactcgggaaatactaaagcctcaacctcaggattacgagtcattgatgagcgtcacaaactcagaatcctcctcactcttcaggaagttgaacaggtccacgccatctgcttcgttgtccggcgcgacactaattacggaggtgacttccaggatctggtgcggaggatgatttcgctattgaccttctcggttcgatctaccacgtggaatctgcaataccacatcattcataccaacattgatgtcgacgatcgagcaagtgatacatgccaggtccggcaacgggagtttgatcaattcggcccagcgggtgctattcaccactttgttgacaacacgccactcgtggactttccactagatgtttatttttcgaaccactctctatcaacattgttcaaatcgttagctaccgcaacgctggtaaacttctcggacctctactatgccaagtcctccgagcatgtgtgcaatgaccaagcattgacaagctcagtggagcgcgacaaggttcaccttaccgaggaaatcgaagactgccgcgaacagatcgcggaattgaaaaaatacattacacgctacaactcaagcgctgctctaaatctgaaacgtgtggacgaatacaaagaaaaaattgctgagatcgacggaggtcgtgaagagggctggaccgaaaagaacgtggctggaggaggttcgcgactgttctccttcagtacaatggtgcctattgcgcgcgttgaaaagtcttacgatggggacggtgactgggaattggaacagcagacatcaacatattaccaagtcacattacaaccccactggctctacaaagcctacggaaaaattacttataatgttattcttataatgttagccaagatgtga

SEQ ID NO: 148 - DNA, 405 bp, Fusarium avenaceum
atgtcttcagctgatcagaacgttggtgccatcatcagtctcacacctcctgatgagggcgacaacatctgggtggccaagcaggtcgatatcgcccgctccctgcctcctggagatatccaaggccgccacagcatcgactggagctttggccccatcaagatcactggatatatcgacaccaacacctatgagattggtgtcagtatcagtattgctggaatcagtgttggtaatatctttggaaatctcaaggatggcgttggcctcaagatcgatctgtttgtcgccaagggtgaagttcgactgtatttgaagaacggaaatgagctctgggttcaccttgatgttaagatcacctttgatggacattttgatggagactacaagatcacctctttctag

SEQ ID NO: 149 - DNA, 1596 bp, Fusarium avenaceum
atgactgaacaacctgtcatgttttcttactgctcggctgaagccaaagtgccagagtccagtcaacttccttccggtaacctgattacacaagatgggaggccaggctttttagccgccaacaagaatctcttctggcccaacggttcgaagctcaaggtcaggtttctcaacggcactgcagtacaaaagaaaaagactcgattctacgccgagagatgggagaagtacgcaaacattgactttcgcttcattgaagagggagatgctgatatcagagtcggattccgatggaaaggagactggggatcttggtcatatgttggcaaagatgctcaaaagtttgcccttggccagaattcggcaacgatgaactttggcgatttggatgataacagccgcgaggaagtgtattctcgggttgtcacacacgaatttggccatgcaatcggctgtgttcatgagcatcaggccaaccccatcgaatggaacgtcgcagcagtcattgcgggttgcaaagccctgtacggctggaatgaagaaacaacacgaagtcaaatcatcaacaaagaggactttcgagccctcgtcaaaacagattttgaccctaactccatcatgtgttactactttccagcctcgtggaccgccaacagtatcgccgcacccacaaaccttaacctctcatctacagacaagagcttcatcgccaagatctaccctttccagacgcgcaacgaaggagaattgagcattgatcccagtatccgcccctggtatccccccgttgccctaaactccaaggccatcctttttacccctccttatctcgtggctccgcgtgtcacgctcgggttgaaacttctcgatgttggtaattcgggtaatatcagtgttcgggcggctgctgcgaaagtcaccgagactgaatttgctctcagcattgactcatgggctgatgcgcagttgtttaatgcggctgcaacctggattgaattcaccgaatctgacagcgactaccaagttggagaatacaacacgctcgacactcgaacactgaccaaatttcctacaaccgacaaagacggaattcgtcgagacaccgagcactttgactttcctgacggtcaatacactgacgaacccaacatcctcgtctggctgagcgctatcgacctggataaaggccacaactggagagtcaaggcctacgccaccaatatcacatcttcaggctttgacctcaacatcgacacgtgggctgacaccgtaatgttcagtgcgacagcatcttgggtggcatatccaaagggccatgagggtgttgcaaacggcagggtcagtagcagtgagctgcgggactggtatcctccctctgcccaggatagcaagaaggtcaagttctcttccaagactttcgatagagaaccaaaggtctttctcgcaataagcgagttggacttggactcctcaaccaaccttcgtgtcaaggttagcgctgacaagattgatgcgtcggggtttgtttggcgtgctgagtcgtggggggacagtagcatgtttaatgttggtgcagactggattgctttcggttag

SEQ ID NO: 150 - DNA, 1140 bp, Fusarium avenaceum
atgaacaaaatccgcggcaactgcagccctaaattcgaggaggttcgctcactcttagagcactacgtggaaagcggcgaggagcttggtgcttcgatcactatcaacattgatggcaaagaggtggtcgatatatggggtggctataaagacccaaaccgaacgcaaccgtgggaagagaacactatcgtcaatgtgttttcgtgtacaaagacagtgactagtctcgccgtcctcattcttgttgatcggggattgattgatgttaatgagcgagtctcacactactggcccgaatttggacagaatggcaagcaggatattcttgtccgacacatgctatctcacgcttctggcctttccggttgggaagaccccttgacaacggaagatctctatgatgtgaaaagaagcactgagatgctagcccgtcaagctccgtggtgggaacctggatcggcctctgggtaccatgctctgtgctttggccatctccttggagagcttgtccgtcgcgtttctggaaaatccttgcgtgactttgtggcagccgaaatctcagatactttggacgtcgactttcagatcggtgcttcggagacaacctgggacagaattgccccgatcgtgcctccggaattttcagggattacaccagaatttgaggctggatctgttcaagcaaagactttgctgaacccacctctggatcccaattctgttaacactgaaggttggaaaaatgcagacctgggttctgtgaacggacacagtaacgctcgggcgttgacacgcatcctctctgctatttctttgggagggtcgactagaggcacgcgcattctcaaggaagagaccattaaactcattttcgaagagtcacaacccgaggaagacttggttcttcgaataccgatcaagtttgggatcgggtttggcttgacgccttgtgtagcacttgactggcttccaggagggaatgtctgtttctggggcggctggggcggttcctttgttgtcatggatcttgacagacgtatgaccatttcttacactatgaataaaatgggaaatggtcttgtgagtagtgatagggctgaggcgtacggcaaggctatttatgctgcactcgaaagttaa

SEQ ID NO: 151 - DNA, 831 bp, Fusarium avenaceum
atgacgacctttaacccacgcgaacttggtgacgtgaaagtcaccgaccgctttaacctcagcaacaggaactatcttatcactggaggtggcggaggcattggcttcgcttgcgcaaaggccatagctcaacttggtggtagcattgccgtcattgatacagctcctgtgcccgtggaagagtttaagactcttagcgaacgttatggtgtcaagacgtcatacatttgtggtgatgtgaccagccaagaatctttggagaaagctttcgtggaatgtgttgagtctatgggcggccaactgcatggtgcgcttacggcagctggcattgttatggacacgccattgcttcaagcagattgggaggtcacccagcggacactaaatgtcaatatcatgggcacatactgggtgatcaagcttcttgcccaacatcttgtcgacaccaagacccctggaagtatagtcgccattgccagtattaacggccagggcatgtatgttcctgtgcaaccgaagtcagcctataacgctagtaaagctgccattaaaggccttatgggcccactggctggagagcttggccagtatggaatcagggttaactgcatctcaccaggcgcaatccaaactcctcttttggcacgtttgcaaggagaaaagcgagctattcttgactggtacgagaacggagcaccagtccaacgactaggcgtaccagaggacttaacacccatggtgtgctacctgctaagtgatgcctcttccttcacaacgggcgcagatatgctggttacaggtggtctccatgcaggaacagccttgaagtaa

SEQ ID NO: 152 - DNA, 996 bp, Fusarium avenaceum
atgacagacatggcagacaagcctcgcgtcattctaggccttttgacctttggtcccgaaggaacagaagctgatggaacccgcatcacttctttggacaaatttaacgaatgtctcgactacctgcaatcccgaggctacaaggaagtcgacacagcccgtacctacgtcggaggacggcaagaagcctggaccaaactcgccaactggtgtgaccgcaagctcactctggcaacaaagtggtatccttacaagcctggcgaccattccaaagctattgtcacgaagaatttgaacaggagtctgaccgagctgggatctgatagcgtggatattttttatcttcacgcacctgatcgttctgttccgtttcaggagactttggaggcatgcaatgagttgtacaaagagggcaagttcaagaagttgaggctgagcaactatgcagcctgggaggtcgctgaactctgtactattgcagaccagaaaggatgggtcaagccgagcctttatcaagccatgtacaactgcttgactcgcgccatcgaggaggagttggtcccttgttgccgcaagtttggtctggaaatcctcgtttataatccattggcaggcggtgtgctcagcggaagatataaaagcaaggacaccgcggacgatggcggtcgattttccagtgcgaacacaggattcggagccatgtatcgcgacagatatttcagggatgacaactttgaggctctgaaggtgatccagccggtcgctgacaggttgggcctgacgcttttggagattgccttccggtggctggttcaccacagcaagctcaaggtcaaggatggcaacgatggagtgataatgggagttagctccctgagtcagctcgaaagtaatttgaacaatctggaaaagggcccgttacccgatgaggtggtggaggtcctggaaaaggcatgggaaatcactaaacactcttctatcacgtactggaggtag

SEQ ID NO: 153 - DNA, 1143 bp, Fusarium avenaceum
atgaagggagaagcagttaccctaatttcaccgttttctatatccccacaatgtcgtcgtatcgacccaaccaagccgcgaaccgccttgttgaaacctgatggctcggataacaacaacgatcgcgtagatattggaacgactccactggcgttcaacacgaccaacatgcagctgtggagtgcacataatcccgctcgagcctgcttcgtcgcagccagcggatatgtagtgctgtgggactttcacggctgcgatcatctttccgcacatctgcctttgattaacgaagtacgaagtggcgcttcgttcttttactatgagaccggcccacgtacccaagaacacgccgcacgtttcgccgcatcagttgacgaactgctcttggaagtctgcgacggacaggtcgtcaccgagcacgcgcggatgatcaagggcccagatgagatccgggctgtgcgctgtgcggtcgcctcttgtgaagcagcggtcggtgagatgcgtcaagctatgcgtgccggtgccacagaaaatgatgtctgggctgctctacacagtggcaatattcgtcgcggtggcgaatggattgaaacccgcattctttgttctggaccgcagaccaacccttggctgcaggaatctggtccacggatactaagtgacggagacttggtgtgctttgacactgatctgattggcgtatatggtatttgcgtggacatgtcgcgtagctggatctgcggtgacctcgagcctactgcagaacaaaaacatttgtatcgtatcgcctacgaacatatcaccaccaacatcgagatgattaagcccggggtacgttttacggagctcacgcataacagtcatcgcctgcctgaaagatatcgcgctcaacgctattgcgttctatttcatggtgtaggcctgtgtgatgagtacccgtgcattcgttatcccgaagacttggaatcatatggctacgaaggagaactttttgcgggtatggtgctatctgtcgaagcctatgtcggtgaggtgggtggcaaggatggtatcaagctggagaaccagctgctcgtaaccgagacgggctatgaactactgactaagtacccatttgaagtaaagaatattatgatgggctaa

SEQ ID NO: 154 - DNA, 2943 bp, Serpula lacrymans
atggtgtactttcgcctgtgtaccatatctgatagcgctgcttcgtctgccaaagtgtcaggcacgacaatcggtgaagtacaaatcttgtttggtgacttattggctaggggtaatgagagcgacccagaaatatcgcttcagatccagtcgccaggccagtctttacaacaaggagaactaatgctcaaagtgttgcgtgtaaatgaaaagaagtcgatggctcatccaagcaaggaggaaggaatatccgaggtaaacagtggtatcacgattctggctacttggctgatcaggagctcagacaagtcattgtcacgcgtgacactggctgaggattcctggactcgctttgagaaaacaaatggcctcgaggatctcgacaaatctatcaattatggacgccaagctctggattcttgccctagacatcaccattacgatagggtcctggggaacctcgcgatagctctccaccatcgctttacacgacaaattgatataaaagatctcaacgaagctatcgtacactacaagcttttcctcgaaaaaaattctccagaacattgcaggtactcactggtgctagtaaacctcgccattgcccttcagactcgtttcgacgtacgaggcagtctaccagatctcaatttggccatcgagtattatgaaggtgttctaaagattcgtcctcttgggcatcgtggtcatgtggattcgctgctggatcttgcaacggctcttagcacacgcttcaaacgaagctctaacaaatcagatttggatcaagctatcgagcactatgataacgcactcaaattgtgtgtaccgggacataatcgtcaccctgctgctctcatggccttttccaattctcttttgagtcgatttgaagtggcaggagatatgcgagacgtagattttgctattttgcacctcaacagtattctggatctactcccgtcagaacatcccaatctccctagtgcgctgctgaacgtctctggagctctagtcgctcgctacaagaagcgcggtggtatacaagatgtggatcaggccattgatcacctgaagagagcagcactattgtatcctcccggacaccatagtctctccaatgtgcttatgagcacaggtaacgcacttttgattcgttctggaaagcaaggcgaccagcaaatcgtaaatcaagccatcgagtactactcaactgcagtaaagctccgccctcggggacaccctaacagatgtaatgccctttcgggtcttgcaactgcgtttcagtctcgttttgagttactaggtaacttccaagatttggatttagcaatcgagcatcatgagaactcggtagagttatatccacctggacacataaatcatccgagggctcttatgaatttagccaacgctctacaaagtcggttcgagcacctccggagtgtgcacgatctggatcaagccatcgtctaccatagtaatgcgctggaacttcgcccgctaggacatccaagtcgtttcaaggcactgatgaatttcgccactgctctggagtctcgattcgacctgcggggtgacattcgagatcttgatagagccatagagtattatgaatacgtagttgagtcctatttcgcagagaatcccaatcgtcccaaggctctactgaaccttggcagtgcacgcgtaactcgcttcaagaaactgcgcgatgagggggatctcactccctttgactacattaagtccgcatcaactcatccttccgcgggctcccacaagcagctaacctcttttcaagagatacgtcaacttgagggctacgttcatttccttatgccaactccttttgacgaattaaaaaaggcagctgacaaaggtccaatcattatcgtaaacattagccggtatcgttgcgatgccatcgtcgtgctcggctccgggaagcctcatgttgttcccctcgttcaaatcactctcgaagatgtttcccaattgtcacaagagtttggcgcagcgctgaagatgtccacagctgctggcgaggagaagataagagaaaaccaaatcatacgtgtgttgcgacaattgtgggatctcattgtgtatcctatcgtcaacaaactcaaagccttggaggccgatgtcccactaggttcgcgtatctggtggtgcccgacttcaaagcttgcttcacttccacttcatgcagcaggaccatatcgtatgggtgaacagaatttgcctcacctcttcgtttcttcatacactccaacattatcggcactcattcggtcgaagaaggacaagtcaactgtttccgagtcgaaacgtgcctttttggcagttggacaatcaaacccctacgggactagctgcgagagtgatctccagtcagtgagtgttgagctcgaagctgtccgccgcaaggtcgtatcatcgcctatgcaagcgcgctactcacagctaatcggagacgaagccactgctggagctgtaatgaatgcatttcgcaagcatgggtggatccatctcgcatcacatgggaagcaagacatgttgcaacctttcgagtctaattttgctcttcgtgataaacctcttcgccttctggatatcatacacgccgaactggagcacccagaattcgcatttttgtctgcgtgtcacactgccgtgggtgacaaggatacacccgatgaggttatccatcttgccgctggcgtgcagttctcagggtttcgaagcgttattggaacaatgtgggcagtagatgacaagactgtgccccatgtggtgtccgagttttataatcatcttataggtagtaatgtcgattgcactaacgctgcgctagcattgcacaaggctgcaaaaaccgttcggaagtttcaggttccgctagaccaaaggatcgtcttcatccatattggagcttaa

SEQ ID NO: 155 - DNA, 7203 bp, Serpula lacrymans
atgtcatccggacttcagagctcgcagaaacaacccatagccattgtcggtatcgccgccgacctccccagcggagactatgcaccaactaatttggactacaagaaattcatggaattcctattgaataaaggagaagcatacgaagaaattcctaaagaacgctttaacgttaaatcatgggcgggagagactctcggtcgagtaattgctacgcgtggcgctttcctcaaggaagtaggatcgtttgatcacgtcgaattcggtatatcaggaaaagatgcccgggccatggcaccgagtatccgtaaacttgtcgagttatcatttttggccttgcttgatgcgggcattgagtatcggggtcgtgatgtcggctgttacgctgctggcacagctttcgacatcttaagtatcacagaaccggatgagttcgaggccaagggttctttcgctggaacaccctctatgatggccaacaaaatatcgtatcaccttgacttgcaaggaccttccgtcccaatggacactgcctgcagttcaagtttgactgccttacatcttgctgtccaggcaattcgagctggagagtgtgaatccgctgttgttgctggatgccagcttaatttgagattggctgattttatccagtacagtcaagcttctgtgcttgctcgggatggcaagtgcaaaccttttgacgccggagctgatggtttctcgcgaggtgaaggtgccgttgtagttgtcctcaagccatacgaagatgctatcagggatggtgactacatctatggcaatatccttgggtcgggaattaactcttgcggaggtgttgctccggtttacgctcctgtcggtgacgcacaagccgaggctatgcgcaaggcttacctgggtatcgaccgcaacccaagagaagtcgatttcgttgaaatgcatgcaactggtacttcggccggagatccagtggagagtgaatggattggtcaatattttaacagggaagaggaattaatgatcggtagtgtgaagggtaacatcggtcatttggaaattacagctttccttgcatctttatgtaaagtgtgcgccattctggagacgggagtggtgcctcctaatgtcaaccttacgaaacgtaatcccgccatcaaatggggccaatacaaattccaagttcctcttgaagccacaccaattaagccgcgttctgcatccggaaagctgttggtttccatgtcgagcttcggtattggtggtgccaatggtcacgtcgttgtcgagagtccatcgcctttgggcgaaccacaggttgttggtcaagttgcgactggccctgttctacttgtggcagctggcttgtcgcctagatccacaactgccatcgctgactccttgggtggtgttgtcaacagtcagcccgagaatctggcggcggtttctgccatttatggtcgtcgagccaggcagatgacatggcggtcctttgctattgctcgcccagggcagcaagctcaagctttacaattcccagcaccagctttatccccccgtattaagccacctatggtcttcttgttctctggccagggtcctcaacatattaacatgggtcgtcagctatttaagaaatttccagtgttccgtgatacaatcatggaactggacgcttgccatcgcgaaatgactggtcactctttgagcgagttggtcggattatttgaagatgtcacacccattgaaactctgccctccatatggccaatttctgttattctcccttcgctcgccatggttcagatggcgcttttcgacttgctagttagctttggccttcgcccggacatggttattggccactccgctggtgagactaccttgttatacgcatcaggagcaggctcgaaggtaatggcgatggagattgccattgctcgcggaaaggctatgactctcgttgagaaagctaatgggacaatggctgctctcacttgcactcctgcacaagcacaagccatcatccacgctgtcactcgtatggatgctaagaagggtatcctcgaaatcgcgtgctataacgctcatgaagctgtcgccattgcaggtcacacctatttggtagagaaagcagtagagttggcaggaacaagaggtattcttgcccgtaaaattcagacgggtgttgctgtccattccagcctcatggaggtttgtgagaattattaccgttcgttggtctcggaagtgtatgccagacaccctggtgcgcacacgcctgtagtgccgacttactctactgctacgggtgatctgaaaacggacgaattcaccgaggaatacttctggcagaacagcaggaatgcagttctcttcactcaagccattggttccatcctcaagactcaccccaacgcttgtttcgtggaagtcagccctcacccagtgttgtccacctacttgcaggaacttggtgttcctatggggtctgtagtgtgccccatgcgccgctccaagaaattggaggaattccacgaagaatccaagctcctggaagcacttggacagcttgtcgtcatgggtcacaattctgtcaatttctgtattctcaactcgcagaaggttatatcgcattccctcactattccaccatacccattcgcgaagaagttcgtgccttacctttctgagcattcccgtgtcgcgcagaagcaatttggcgttcgtaacggcccattgaaccatgtagatctgcgcatcaataagctcacacaccctgaaattgcacaacatcttataaacgatgaacctatcatgcctgctgcaggatatctagaaatggctttggaggctggtgctaaggtgctctggaatgtgaagttccatacaatcctgtctatgtctgcggaaagccctgtaccagtcgaggtggagatagaccgtatgcactgggccgtgaaatctcgtggcggttctgcaaatcttatggagggtaccactgttgcatcgcgtctgcacgccgatggattcatgtccaaggtcccagtggataatctggataatcttaatattgaggctattcgcagtcggtgccagccgcgtagcatggagaatttctatgatgctctaaagcatttcgctcaatatggtcccgttttccgtcgtatcacagagttcaatatgggcatagatgaagccgtattgactattcggggaggggctgctgatctacctggatttgataactttgtcattcatcctgctatccttgacgcatgcattcatgtggtagtgcatccttccttcacgaggaatccggatcacaaggtttactaccttccggctcgggtggagactttcatggtgcatgagcgcctctcccaaggtactttccctggaacagtgtatgcacatgctgtattgagagagtggcgaccttctgaattggtaaccgatgtcactgtggtcgactctactggaaccagactatgtaccatgagtgggctggtcgttgagcgtcattacaacactcttcctcgtaccattagcaaacgattcaacgttgcatatcaaccatttggcatctctccacgtatgcgcgtgcccaaagagcactcggttccccatggtgcagatccagaggacgcattgttccgaattgctcgtgctgcgttgaaccatctgactggtgtgtgtggaaagaaaactattcgtattttggctttggattacggttctggcgaactgaaccgccagctttgctcttcgtttgaaaagattgtccaatcaggttctagcgtcgcctatttcgttagcatgaaagattccgcatctttggcacagcaggctctgccgcgcttttgcagaccggtgtctttggatttctcagaaccgttggataagcaaggcctcccgcaagcctccttcgatgctgttatcagccttcaggcattaggatcacgtgattctcttgaccaagaccttcatcagctaaactctttacttcttcctggaggattcttgctactcgctgaacctgctcaacgatcatcgaatactccttctagtagcctgcatacctgcagtgaatggctttcactcttcagttctttgggaatgcgtactactacccactgcgtgaaggctgatacctcgcccttcgttgtcctggaaggccagcgtcaatcaatctcttttgctccctcctcgggcgcaccgaaggaagatatattgttcatatcatatgctgttggccgcgaaatggagattcagcgcatactgaagggcctggacattgacaatccagcgaaggtttggttcactgctacggatcccatggatgccgatggtggaagagggttcacgcgttcagttcggcgtgagttcccactgtgggatatcggctttgctatcttcggcttccagtgtcctcgagctgagcagaccaacattatcaatcgtcttctagcaacacctggtatggaacgggaagtttatgtcgatgaggagtatcaagtatttgtccctcgcttccatgaaggtcctactgtgtctcctggtaccaagatcgaacacggtgattcgaccgaattatcaccatccgatgtgcaggtcactgttgtcgcttcgtctccctcagatgctgggttctatggcgttgttgggcgtgtgacgaatgttggtgatgaatcagacgcatctttggtcgactccttgataactaccgtcgtgaagagcgcaccgacaaagcacctgagggtgcacaggggtgctgtaacacctgtcccggatgaacttgatgcgcaagtcgtggcatctgtcatcccagttttattgatcggtggtttggctattggcgcaggagctcttcgggatccatcgcgcatgaaatcgggtcgtatcgttgttactcacagtgacacggccactggtcaggcactcgcctggttcctgcatactttgggtctccaacccattggtgtaggctccaaagcttcgccgtttgaactttcgaagctcgctctccgcaacggggacctggttttgtctggctacagtcacgacaatcaacttttgacaagcttcgttgccgagggaactcgtgtgttctcttgggccacaagcataaatctcgcacacactctttccagcgacccttggcttgttggcgatactttgcaggctgcagttgacatatcctcggaattcgagctgcctaatgtaaaagtgctcagtgggcctagtaccgaatcatcttctgcgagctccaagttattcaaggctgatgaggcatatctgctggtaggaggtgttggaagtttgggtatgcacattgctctgtggatgtacgaaaaaggcgctcggcacatcgtcttgacatctcgatccggccgccagtccttagaacgcgcaaatgatattttagccatgcgaatgctcagttaccttgagaccagaccagacctagacctcaaaatagaggcttcagacgctacctctttagaagcattgcagaagacgctcgcgggtgttacgcgtcctatagctggttgcatgcttttacccgcaatcttaattgacagagggttcttctcgcaggatgcttcgagcttcaagaccgtcttcgactcaaaactgcgtgtgttcgagacagtggaggctggtcttgatattgcgaagttggacttcttggttacgttctcgtctgtcgtaacctttggtaatgcaggccagaccaattatgcaagtgcgaatacggtggtggaaggcaagacagcacaatacaggaatgccttttctatcatcaccccggccattaccgacactatcgctatggtcggcagagctgatctcgacttccaagtacatggacggcacttattggcctggtcctactctgctagagagctttgcaactgcattgaggatggacttttcaagcttcaggatgaacccttcaaactttatgttccagaccttgactgggagcttgtcgaaaagcatctaggaccttctccgctctacgagcatttaattccacgatctgcctctgtgcaatctgcgccgtccggagaaagcgctgctgatgcacttcgtaacgttgttttacagttccttgatgtggacccagccgacttctctgttgatgtccccttcacttcatatgggattgactctctgtccgctggtagactgtcctacgctttacgaccattcatcacgatttcacaaattcaactccttggtgacatcagtcttgctgacgtcgaacgccgtattgaagccgagtctcagactgaggatatctctaaccccggctctgcacatgatgtccagaaggatggtggctctggagtgcaacaaccggtagtgaagatagcagattacgaaggtgatacgccattgatccttctccacggtgccagcggcagcattctccccttcatgtctatgaagcagaacttcaggacctcgttgtgggctcttcagactactccagaaacgcctgtgcattcgattagagccattggtcagtactactacgaacacattaaggcagctcggccgcatggaccataccgtcttgctggtttctgcgggacttccactattatctttatggtcgcgcgtatcatgcaggataatgcagacgaagttgttcagctggctattcttgatcacttccctctcttgtgggcctcacccctcgttaagcctgacgaagagagcatcaacttgcgcacatctggtcccgctgtcctgaagcgaactatggacactatgctgcaattgtatagaatcgacggcgcgccctcacgtgttcgtaccgctgaggactttgataaattgatggatggtcacgaggtttctcctcaagttcgcggttggatggataccataaccagtcttcttgccgccacttacgaattcatgttcgagttgctccctgccgacgaaccttactcggtcgacgcattgcgagaagcatttgcaggctggttgagagagctgcgtgtacctatcaccatgtacatggcatcggggggttatattgcattgattcctgaggaagagaaacaaggctgggagcagtactcgattcattcggtgtatcctgatgccaaagtcatgggattcgaatgcagccatttccaaatcttagacttgccagagcttgcagaggaagtccaacgtggctggtga

SEQ ID NO: 156 - DNA, 1272 bp, Serpula lacrymans
atgtcttccgaatcctcctcacctgcctttggtcacgccatgcgctcgtacttcgggtttgattcagactacattaacctgaatcacggtgcctttggagctgtgcccaaaccggtagtcgaagcagctcatgctctaaccaatcgagtcgagtccaacccagactacttcatgaggctagaatacgagttactcttggacgaagggcgagcacgtctggcacaactcgtcggtgcagatgtggacgaatgcgtgcttgtcccgaacgtaagcaacggtatcaatacagtactacgaaacttcgaatgggccgagggcgacatattggtgtctgccagcaccactttcgactctattgcccgagcggttgaaaatatcactggggcacgtccacaagtcccacaccctggcgtctccaagttcatcctagacttccctcagtcgcatgctactatcctagcttcgttccgcgaacaccttcgtgccgtgaagtcacaggctccgaacaatacgattgtggctctcattgacactattgtgtctcagccagctatcttaatgccttggaaacagatggtcaagatttgcaaagaagagggggtttggagcgtgattgatggtgcacactcacttggccaggagctcaatattggtttaagtgaagctgaccccgatttctgggtcggaagttgtagcaaatggatgtacactaagcgtggatgcacccttctctacgttccaaagcgcaatcaacacatcatcaaaaccacgcttccgactgcgcacagtgtcctggccgcttcagaagataagccccccaccgccttcgtgatggaatttatatattttggaaccgtggaggctattcccttcctcagtatcaaagcagcattggacttcagggattccataggcggagaagaaacaatcaatgcttactgccactcgcttgccaaagcaggcggaaggcgtctcgccgaggtcatggggacatctatgatggtaacagacaatgaggacgaactgattgccaacatggtaaacgtggaacttccttttcccgcaactattgcctcgaccaaggcagtattccgcgttttccaaaacagacttttacaagaccacaagatgtacgctggccatttcttccacaacggaaagtggtggacgagggcctgcgctcagatttacaatgagatcggagatttcgaaaagcttggatatgcgctcgtcgctatatgtaatgagatcaaagaagccgaggctcggtaa

SEQ ID NO: 157 - DNA, 1521 bp, Serpula lacrymans
atggctcctaatcgaaacagtattcgcactagtcttcgaaacagcatcgcaattgacctttcgtcggtgggccatggtgacaatgcgctactcgacgggggaaaagtaggaggggatgaggaacccgcactcattgtttcgactggcaggcccaatcgtaacagtgtacacaccatcgacttggctgcaatgtcggagatggtgcacggcgtgaagggttctgaccatggcggattaaagtcattacctatcgaagaggagcagaaagtttacgttgcaccacagccggttatggatttccctgaaggtggttggagagcatgggcaacagtggctggatcattcttgttcaatttttgtggttttggttatacaatgtcgtttggcgtgtaccaggcttattatgtcgaacattatatcacaaaccagtcgacttctacaatctcgtggatcgggagcgtgaattcatttttgatgatctctggcggtgtaatagttgggaggttgtttgacaaaggatatttctatcatctcattactattggttcactattatattgtttttcgctttttatgttgtctctagctcaacctgataatttctatcaaatattcctcacccaaggattaggaatgggcataggagcaggtatcatctatgtccccacggtcgccgttgtatctcattacttcctgcgataccgagtgattgcgatgaccattgctgtatcaggaacttcacttggcgccgtcatccatcccattatgatgaataaactactcaacagtaatatgtcatttggaaatgctgtgcggataagtgctggcatggtcacaggcttgctcatcatcgcttctatgcttatgcgcacgcgacttccgcctccaaaacgcctcattcctttgggtgaagcagttaagaaattttctcgtgatagagcatatgtgttcgcggctttggggttgctggtcttcaccatggctttctactacccgctcttttatattcaactagatgcaacggcccatggtctcagtcaaacgaactcgttctattcgctcgtcattttgaatgcctcgagtttctttgggcggatccttcctggcttctttgcccagaccctcggtgttcacaacatgattactgtggctgacatggggtgcactgttttgatcttcgggatgatcgggcttcgcaacctgggaggctttatcgccgtcgagatcttctacggattctttgcaggaacatttgtaggtctgatgggaccattgatggctttgttaagtgatgatgtctcagaactgggggctcgcatgggtatcggtttcttgttctccggtctgggtggtttgattggtacacctatctctggtgctttgctctctactcaggatatctggtggaagcctgcactcttcagcggagttatgggagccggtggattggccatgttcgtcctgatgcgcgtcgaactttaccgcagaacagccaaaaaacagaacactgtggcagcctga

SEQ ID NO: 158 - DNA, 7242 bp, Coniothyrium sporulosum
atgacttctagatcaagcctttcctcagaaagctatgacaatgtagctacatcgagtatttccgagaaatgctctagtgacgaaggtgttgcggatgtgacgtccagacagagaacacaggtacccgttgcgattgtgggtatgggatgtcgtttgccaggacacagcacctccccaacagcattatgggatttgttggaaagaggcggcgtagccaaaaacgaaccaccaccatcaagatttagtttggccggccattacgacaaagccaacccaggaagacccagaactatgaagtctcccggtggcatgttcatcgaagacgtcgatcccgctttgttcgatggccaattcttcaacatcagcagaacagaatgcattgctatggacccacagcaaagacagatgctggaggtggcgtacgaatgtttggaaaacagcggtacgcccattgagacgctgagcggtactaacactggtgtgattgtgggcaccaacttcatagattatggtgccatccaggcaagagatccagaaaacagagcagaatcagtcatgatcggtttggcacccgccttgttgagcaacagaatctctcacttcttgaacgtaaacggtcccagcatgaccgtcgacaccgcctgctccgccggcctcgtctctttggacgtagcttgtagatatctggacagcttccagaccgacgccgtcttggtcggcggcgcaaacttgtggttgtcccctgagcacaacgaggagatcggcatgatgcacgtgacgcagtccggctcgggtttgtcgaagagcttcgacgcgtctgcggatggttatgtcaaggcggaggcggtgaattgcttctttttaaagaggcttgatgacgcggtaaggaatggtgatccaattagaggtattcttagaggtacggcggtgaatgcgtcgggtaggacgaacggtattgcgaatcctagctcagacatgcaagcagcagttactaggcaggcactgaagaatgcgggtatcaaggaggaggagttttacaagacaagatttcttgaagcccatggcacgggtacgttggcgggtgacccaatcgaggccaggggcgcggcggctgtgttcagcaagagcagagaagctaacgaggagttgatcatcggttcgatcaagagtaacattggtcactcggagcctgcagccggactgtcgggtttgttgaaagccactatggcggtggagaagggcatcatcccaggtacaccaaccttcttcaaaccaaacccaaacatcgactggaaaggcctgcgtataaaagccagcagaatgtccatgccctggccaaaggtagacgcagacaatatcagacgtgcaggcgtgaattcctttggatacggaggtgccaacgcacacgccgtggtcgagaacgatgctcaaggactttccagacacgtatcctcatacaagcaagtgacgactgacttctttgacgatgatgacgacgagtttgacgaggatcaggaagatggcacccaagccactccaactctgttgttcttctcggcaaacgaccagtcttcactggacgagtacatcaagaggttcagctcgcacttgcagaacccactggtgtcgcttgatttgggagatctagcgtataccttgtctgagagaagaagtagacactaccagggcgcggtggctatcacgcgtgctaacctgcagcacatcaacacggacaccctgatcagaggcaagagaacgtcgaccgcgcctagagttgcctttgtgttcactggtcagggcgcccagtggccaaccatgggagctgatcttatcagggactttcccctagccaggagcacggtggagtaccttgacagcgtgttgcagagtttacccagtccaccatcctggtcgttggtggacgagctgaccgccaaaagaagcgtcgaggccctgagacagcctgagttctcgcagcccttagtcacagcgctgcagattgcgcttttgagagtgctggaagactggggtatctcacccgaggccgttgtcggccactcctctggagaaatcgcggcggcatacgctgcgggtttgctgagcgactccgacgctattaaggtggcctactaccgtggtcagtcgtctaaaaagacggaatcaggtgaggccgtgggtatgttggctgttggcattgatgaggcggcgttggcgggttatcttgaggcaaaggcgaacaagatccagattgcgtgttacaacagcccaagcagtctgacgctatccggcttggtatccgagttggaggagctgagagacagaatccaggccgacggtcacttcgctaggctgcttttggtcgacttggcataccactctgactacatgtccgagcttgctgaggtgtatgaaggcatgctgcacgaggacggtttgttccagaaggcagccacgcccagacctaagacaagaaagcccgttgccatgttcagctccgtgaccagcgcggttgtcgacccagatatcaagttggacgccgcgtactggaagaagaacatggtgtcgcccgtgagattctcgtctgccacggcgcagctgttgaagcagaccagcgctgacttcttgatcgaattaggccccagcaatgccttggcgggcccaatcgctcagatcaagaagggcttggacaaagacggacagtatacctctgcgttgaagagaggtgccgattccacaatgcccatgtacgaggcggccgcgaaactgttcctggcaggagatcagcaggtcagtcttgcaaaggtgaatagagtaagcccacagacgtcgaaggtcattgtcgatctgccaaactatgtgtggaaccactcgacgagatattggcacgagacgcgtgcgagtaaggagtggagatttaagaaattcattaaccatgacttgttgggctcgaagatcagctcggtgggatggaacgcgcctatcttcaaagccaacatcaagctggcgcatttgccatggttgagggatcacaggttgggcactgacgttgtgttcccagccaccgcttatatcgcaatggctgtggaagccatgtaccaaacagccatggttaccaaatggaaccagaaggagcctgaaagatacagattcaaacttagagacgtgaagcttttgagagctctagtcttgaccgaggacagggaaaccaccatctcactgtcgttgacgcccgtcagaggttcgaccggatcatggtacgagtaccaaatgtgctccgagcaagatggtttggacgtagacgtcgttcacagcagcggtatggttagcgtggaaaccgactacaaagactttaccaaaactgtggagccattggagttggctacaagcgcgaagcagtggtacaagaccatggccgaaatgggatacaattttggaccatcctttcagaaacatgtgtcggttgagtcgacgatgggacagcgtcagagcaggtcgcttattagtttggaggctcctccatcgcagcccgagggtcagtcgtggtacccacttcatccaggtgtgttggatggttgcttccaagctacaacgccatcgttgtggaagggccagctgcctcaggcgggtgacccagcgttggtgcctaaggctattgagagcatgatcattgaatccggaagtgcgcgtaagttgagagctgcgagcgagggcattgcctacgcgtctgcacactacctgggtgccggagacgccggtaatgcgagaaactacagcaccagcgtcgatctgtacgaccccaaggatggcgcactgttgttccaactaaagggcctggcttgggcggagatggaaacgagcgacgaggagaaagtgccccaccagttcatgcatgtgaactgggacgctgacatcgacatgttgatagaaggtgagccaactctgagcacgacctggttagactccaggactgtgcagcaagtcattgatctggtggcgcacaagagcccagaattgagagtcctggaggtcaatctgagcaccctggatggctccaatttgtggctggagcagggcaaggatggtactgacaacccagtcagagcgggctgctcgcagtaccactttgccgtcagagatcctaagacgttaatccaggcccaggaaagattcagctcgagagcgatcacgccacagtttcatctattgatggatgtcaccaagcctgcaacgattactggagcggacagtattgatttggcgatcattaacccaagccaagacgaattggttgacgtggatggttttattcagggtctggctccacttgtccgtgagggaggattgatcgtatcgaacggtttcagaggcatcgactcgctgggaaagacgatccatctgagcaacggtgtgagcatctgtcgtgtgactaggggtgccgtcttaatcgacggtgaaacagaaattccccaaaggagcgtgactagagtcagccttctggacaatgctactcaaggctccatctcggaggaggtggcgaaagtatgcgaggacctagccacacaaaaatggcaccttgagaacgcttccaacccctttgaagacatcacctccaacaccggcatcgtagtcgtattagacgaattgttctcctccgtcatgcagaccatcgacgcaaagcagtgggagcttttgcagcaccttgcgaaagtacaaagacccttattgtgggtaacgagcagaagcgccgaccccacgcgtgctgctgctgtcggatttctggctaccatcagagctgaggagcaagtgccattcttcacgttggatgtcgaagccagtactagcagaacgtctatcgatgcgttgtcggcatgtcttggtagagtctgggacatgacgtcctcaaagacgttcgacccaagagcaagcactgattacgatttcgtggagcgtggaggcattgtgttggtcagcagagtgtatagagacagtgcgttgactttcggtcagagcaccagccccgctgacagaaagactgaggtcatgaacctgagaaaaagtgatagtttgatcagatcgagagctgagaaagtgggcaatcttgattccgtgcactttggcgaggtggatgcagagtcttctgctttgcccgagggtatggtggaagttgaaatccatgcggctggtatcagctacaaggatgtagtcgtcactttgggttccgctcctggcgatgataccgctcttggccacgaagccgcaggcgtagtcaccaaggtggcccagggtgtatccaggctgtcagttggagatagagtggttgtttttgacaaaggctgcttcgcaaatagaattcacaccagtcccgctagagtccatagaattcccgattccatggacttcgaaaaggcagcgacgatcccaaccgcctttatcactgctatacactccttgctagaccatgccagcttgtcagctggtaagagcgtcttgatccattctgccgctggtggcgtaggtattgccgctatccagatagctcagtacgtcggtgcagaagtgtacaccactgttggcacgaacgagaagagagagttcttgaagtccacgttcggcctggccgataacagaatcttcaattcgagaagcaccgagtttggcgaccagatcctgtccgcgaccgatggcagaggcgtggacgtcattttgaattccctgactggagacacgctggacgagtcattcagagtccttgctgacggaggtatgatggtggagcttggcaggagagatgttttggacaggaacagcctgcctttggctccattcgacagaaacagttcgttcagagccattgatctatccacgggtaaggcgaacgattcgctggtggcccagttgatgtcgaagctgtttgaattggtcgaaggaggtgccatcaagcccatcacaccagtccataagtttgcgtggacagatattccaactgccttgcagttcttgcgacctggaacccacatcggaaaggtggtgctgacacaagacaatgaggtccacgttccagttagaagagcgccaaagagtttgggtttgagagcggatggctgctatttgattgtcagcagtttgcgtggtttgtgcggaggtcttggcatctatttggctcagcaaggcgcaaagcatttggctgtcatgtcgcgtagcggttacgcggacgagaaatccaggctggttatcaagcagttgaaagcgttgggctgccacatcgatttgttgattgcagatgtgacggatgcagaggctgttacgaaggctatgcagcagacaaccgtccccatagtcggcatcatccagggtgccatggttctaagggatagaccctttgagtccatgacattgaccgagtaccacgaagccctgcaatgcaagatcagaggaacctggaacctgcacaacgcagccgagtccttgggcctgaagttggactccttcaccatgttgtcgtctctttccggtatcatcggtcacgtcgcccaagccaactacgctgccggcaacgtcttcttggacgcgttcgcggcctggcgtcaagcccgtggtctgcccgcctgctcaatcgacctgggtatcagcgaagatgccggcgtcatcgcggagagcgccaagttgcagagctcaacagagaaaggcatgttcagaagcctgaacgaaggtcaactgagaaagatcttgtactttgctatgctgcagcagcaagagacgccatcggcaagcgatgttggcgctgtcagagagttggcatttggccccatggtgacgggcctgacgttcccacagcccgacgactcagctttgaagggcgatgcgagattctccccattgttcaccagcaatgagagatccaaggatttgaagtctagcggcgagaacgccaacgcggacatccaggcgttgtttttgttgctgagaaccgagtctgcggatcccgcgtcgagactgaaggccctgatcgatgtgatcaacggatgcttcatgagaatcctgagacttgatgagccaatggatccagaacgaccgatcagtgtctatggtacagactcgctggcggctgtcgaggtgagaaactgggtgaggacggagttgggctgtctggtgacgacgttggatatcatgactgccacgtctttgacgtccttctgcgagaagattttgacgaagttgttggctgcggagacggccggctga

SEQ ID NO: 159 - DNA, 948 bp, Coniothyrium sporulosum
atgggttccatgcagaacatgcccgtcaaggaggatgtcgaattcaaaacgcttgacggtttgactcttagaggatggttgttcgcgggccctccaaaaggccctgccatcatcatgaccccaggattcaaccttaccaaggatatgattattttcgaagctggacagtatctgaaccaggcgggtttcaccgtcttgggatatgatcctaggtgtattggaacgagcgacggcatgccaagaaacgacacccaacctatgaagaacatggaggactaccacgacgccttgacctacttgaaggtgcataggcgagatctggttgaccctgagagaatcgcattctggggctactccttcagcggtgcgatcgccttgtgtgccgctgcccttgacaaacgtgccaaagccgtaatagcctgcgcagccaccacgacttgggagttctcgaaatggaagcaagtcctggccaaggcgatgaaagacagagagtcgcaattggctggaaaccagggcatgtatttgccactgttgaccgagactggcgaccaacccgcaggtctgggccagggctaccaaggcgaggatgtcttgggcatcattcagagacatgcgtctatcgagccaagcttcatcccaagaacgactctgcagacgtactacaacattgcggcgttcagacccatggcgttgatgcaatttgtggatcctacccccgctttgttgatgacaggagaaaatgatgagatttcgccaccagagctgcagagaaagttgatctacgatgccatcacgggacctaaggagtttgtgacgatcaaggataggaaacatatggatattttgacgggcaacggttccttggaggtttttgagaagcaggccgagttcttgaatcgtgtcatggttccaacgaagggcgccaacggtgtcaagaaaaggagctga

SEQ ID NO: 160 - DNA, 1569 bp, Coniothyrium sporulosum
atggccttgccaacatcaggtgctgccaccttgtcagaagctgtgcttgcgttggttgcgctatacactttgtgtgttgtcgtgtatagactgtactttagccctctttcaaaattccccggaccaaaacttgcagccgccacaagttggtattcaaagtacttcgaccttgtcgctaagagacatggtggccagtttccaatggagatcaagagaatgcacgaggagtatggtccaatcgtgagaatcgccccagacgagcttcacatcgacgacccagaatactggcaggaagtttactgcaacaatagcgcaaccaggcctatagacaagcaagaaaagctacagcaccgtttcggccttcctgatgccatcttcagtactccccaggcggaactgcacagatcaagaaggcaagcaatggctggtttcttctctagacagagattaagagaaactcagggcagagtcaatcaattgctggagagagtctcgcaacgtgtctccaaagaatatgctggttccaatcgtgttttggacgtcggcgaaatgttttcggccctggcggttgacatagtcacggaagtgtgctttcgtagatgcaccaactgtactgaggcacctgaattcaaggcaccacttgtggtcaccatcataaacaacatttggctgagccactggaatgcgcatttcaggtttctactagcttggattgagctgttgccaaacagcttcatcggtattcttgtacctgccatcaagccaatcctggatcttagagtcagcatcaacagacaggtcgcagagatactttcgggaatgaacaaggcttccgtcggtacgaaggactttagagactcagaccatgataccatctttgacgaaatgttggcatccaagcttccaaccaatgagttgtcgtttgacagactgtcgcaagaggcgatggccttgaccactgcgggtgtggagacagtgaaggcgaccattaccttcgctattttccattgtctagagaagcctgctattgaggcccgtttgaaggcagagctgacagaggccatacccgatgcttccatcattccaacatgggtcgagcttgagaagcttccctatttgactgctgtcatcaatgagagtctaagattgagctatggtacgacccaacgtagcccaaggatcaacagactgcacgccatgcaatacagacaatgggttatcccacctggcacagcagtcggtatggactctttccatatgcacaccaatgcggaagtgttcccagagccccttgtttttcgtccagagagatggctaggtaatccaaaaggtcccaacggtcgtcaacctctgaccaactacttgaccacttttggtgctggctctaggatatgtgttgcgatgcatctggcttacatggaggtctatgtgggtttggctgtcatgatgcgtcgtcatgacttccatctgtttgaaaccgatagatctgatgtggagttcgctctggacatggtggcgccaatgccacacagagaaagcagaggtgtcagagtcacggtcagcaagtaa

SEQ ID NO: 161 - DNA, 750 bp, Coniothyrium sporulosum
atggctccttcgaccgtagttttgatcactggcgccggcagaggcattggtaaggcactaacagccgcctatttgtcgtatccagatcatgttgtcatagcgaccgttcgcgatcctaaggctccaaaagctcaggaattgaagggcttatccgtgggaagcggctcgagattactggtcgtcggcatcgagaacacaaaccctgaggacccaaagcaggccgtcgaaaccattgaggctgctggagtcgatcatatcgatgttgtcatcgccaattctggcatctccattggcgccgctcctttggaattggccgaccccaaagccttcaccgagagcttcaacgtcaatgtcttgtcaggcgttgtgctgtaccaggcagtgagcaaactgttgacaaattcaagcgccccaaagtggatctccgtctcaagtagaggcggttccacctctgctccactgccttggtacccatacgcggctgcgtactgtatgtcgaaggctgcacaaaactggttcacacaaaccttgcatgttgcaaacgcatctcttactgcttttgcaatccacccaggattcgttctgacagatatgggaattgcggctgctactggcgctggcatcgcattgcccgagacttcgggcgatgagagtgccggcaagatcatcgaggtgatcaaatcggcaacgagagagaatacttcgggcaaattcttggacgtcgacacccgtgaagagatcccctggtga

SEQ ID NO: 162 - DNA, 1518 bp, Coniothyrium sporulosum
atggttgttgcaacttttggaactttgagtctagtacttagcggtataacactggcaactaagagtcctctacatgcaagagacgacgcatgtgcagctctagctactgtattgccacaagatgttgccctgccaagcaccacagctttcactcaatcgagctcttactggtcacaacagcagttggaaacccaaccacagtgctttgtgacccccaagagtaccaaagacgtgtcgaccataatggaagtcttgacaaaaggaaattttccattcacggtgaagggtggcggccatattccattcgccggtggttccagtatcgaaaatggtgtgacgatcgacatggtgcacttgaacgacatcaaggtttcttctgatcaacagactgtatccatcggtccaggaaacagatggattaatgttactgagactttggatccccttggcctttccgtcgtgggaggtagagacatgaatgttggcgtcagtggattgttgcttggtggtggaatctcgtacttttcgggacagtacggatgggcttgcgataacgtacgtcgttacgaagtcgtaatcgcgtcaggccgtgttgtctatgcgtccccaagcgaaaacaaagacctgtactgggccttgagaggaggtggtggcttgaacttcggtattgtgacgaggttcgaaattgtcgccttcaagcaaggtaaaatctgggagaacgccttgagcttccctggcagttcaaatgcgacggtcatcaatgctttccaaaaccttacagctcgtggtttccctgcggataaagccgcgtctggcttcgttggcataaactatcatggctccaccggtggatactcaaccgacgtaggccttctacacgccacagtaccttccactggagagggtttacctgcagttttcagaccattccaaagaatcccatcggcaactgccaactccaccgtcacagctgatgtctcaacctttttgaaaaatttcgctacgccatatggccgtagatggacatggggcaatgtcgtcgtctctgcttctttctcaaacaagtttcttgccgaaatcttgtctttgtatgaaactagaaatgttggcctgttcaaaacgcagggagaagatgacattacccctactgcacttttccagcctattccattgaacgttctggaagcaatgcaaaagaatggcggaaacgcaatgggactgaagccttcgaacggaccattggtcttgatatcttttcccatgtcctgggcaaatccacagaatgatgatttggcctatggcgccacgcgtaaattgatcgccgacgtcgaagaaaaggctaagaagtacaaggtatacacgccattcgtgtatttgaattacgcggacgccaagcaggaggtgcagaagggctacggtaaggagaactatgagagattgcagaagattgcaagaaaatacgatccacaaggcaagttggcaagactatggaagggctacttcaagcttgacaggtga

SEQ ID NO: 163 - DNA, 1287 bp, Cochliobolus heterostrophus
atgagtgccttggagatatctagcgaagtatgtgacgttccaaatggcacccatgggacgaagcgccgccggagttcgactgtgctcaatccaaggagttatgtcaaagagaagctttggacacaagctccagtatttacgggtagcaccaactttgagccacttgcagatgcgaagaacatcttgatcactgggggcgccggcttcatagcctgctggttcgtacgccatctagtccttacgtacccccactataatgtggtttccttggacaaattggactactgcgcaacactcaacaacacgcgcattctcgatagccgaccgaacttcacattcgagcagggcgacatcacctcgcctgctactgtgaagcgtgtgctccgtagacacaaaaccgacaccattgtccattttgcggcgcaatcgcatgttgacctcagctttggcaactcgtacgagttcacgcatacaaatgtttatggaacacatgtcttgctcgagagagcgagggaacatggtgtcaataaattcatacacatctcgacagatgaggtgtatggtgatgtgcctgttggcgcagcagacctgggcgaaacgagcatactagcacccacaaatccatactcggccagcaaagcagcggcggagatgatggtcagcgcataccggagcagcttcaagctacccctaattacggtccgggcgaacaatgtatacgggccacatcaatttcccgagaagattatacccaaattcatcatgctcttacagcgaaagcgaaagctcctcctccacggcgacggctcaccaacgcggcgttacctctatgcaggagatattgtggatgctctggacaccattttgcacaagggtgacattggacaaatttacaacattgcctccaaggatgagatatcgaatacggagatctgctaccgtctccttgataatttcggcatctcgcgagatacgacgagcgaattaaaacaatggattcagtataccgaggatcgtcccttcaacgaccagcggtacgcaacggatggatcgaaacttgctgcgctgggatggcagcccaagacaagcttcgaagaaggccttcgcataactgtggattggtatcgtagatttggcgaagtgtggtggggcgatatcagccgggttctgacgtcttttcccgtggtaacaggaaatgaaatcaggacgaaggaggagcacgaagatttaccatcgtccgacggtgaggggatacacgaagaagatagtgcagtatggacagtctag

SEQ ID NO: 164 - DNA, 1500 bp, Cochliobolus heterostrophus
atggattccgctgaacaaagagagtggttctttcttgagaatttaggcctacgagtcaccctcatacttttatctggaatcaccgccttgattgttgattacagccgcatgctctatttaagaaaaaagatgccacctggcccattaccctggccaatagccggaaacactctcagtctcccgaaagagaggccttggtacatggttgagcagctctcaaaagactacaagtccccagtaattacgttctggattggacggttagtcctcaatgagatccttgtcaaacgctccaacatctacaactctagacgacacatgctcatgtttggtgagctgatgaatgaacaagataacctcatacacaaatacacatacaccaacgagcagcgggagagatttcgtgtcctgcgcaaaatcacacatcatggtgttggaacacaacaagttcaacaataccgagaatttcaagacgacaagaacatggtgctggcatacgatatcctaaaaacacctgagctatttgcttcacgttttgaacgctacgcggcgggcgttgtctctattgttggattgggacgtcgtatttccaacagtcaagatacgttgattacggaagtcatcgctcagatgcaacatgccgcacaactcgctgttgtggcaaaagactggctacggatcattgagacatttccttggttggtaaagcttccccgtagtatcgcaccctggttacgcaatattaaacaatttagcaaaacaaagtacggtcacgaaaactacgcaaaattcctctttcgcgaagccccacaatacaaccttagccgcggcgaagtctccagtcttgtctccaatctttttggcgcaggcgcagatacatccagtagcactctcatcacagctgtaattgctatgcgcgccttccctgagaccatgaaacctgcctgggacgaacttgatcgcgtagcaggccactcaagaagccctacgcttgacgatgaattgccttatgtccgcgcctttgccaaagttttccgctggcgcgcagtagccaacctcggaggaaaaactcatgcaccgactcaagacgactactggaactgctacttcatacccaagggaacttggatacaagggaacgtatgggctattcatcacaacgagcgcgagtttccggatcccgatcgatttaatccaagacggcgcctcgacacggaagatctgagaccgtttccgggagagaagggatacatgacgtttggatggggaggaggagttgtgctggtcaggcgcttgctgagcagggcacgcatctcagtgttgcgcgcttgctttgggcctatcacgttgagcctgctatcgacgagaaaacaggaagtgagataccagttgatatcttcagctatactaacggatcaaatcgacgtcctcagcctttctaggggaggaagcactgatgcgtctatcaaaatacgagaggccggcaaagtatatgcttga

SEQ ID NO: 165 - DNA, 5376 bp, Cochliobolus heterostrophus
atggaggttgtatatttcagtaatgagttccctaaagatgatctctcggagatcttcagacacttgcacaaccaaagcaagaccaccgagcacgaaattctagcccgcttcctcagagacgcaacaagagcagtcaagaaagagattgaaagactcccatcaactttgaaaaaccagatccctaccttcgatactctcatctcttgggtagagaagaaggagctccgcgagggtgaactatgtggcgcggtcgatggagttctgctgatactcgttcaactcgcggtttacatatttaatgctgaaagcagtaatgattcaacattctcgcacgatgaaaagcacctcacgggtctgggcgtcggcttgctttccgctaccgcggttgctctagctcgagacatttctgaactagctttctacggtgtgcaggcgatcacagtcgccttccgcatgggagtccatgtacaaggcgtttcacattatctagaagctcgagacccggctgaacccccaaagacatgggcttatgtggtccataacgttgatccccaagagacgaaaaaggagctagaagcataccacgaagcagtgcccagttcggataccagtcgtatcttcatcagcgccatcagccgaacatctgtcacaatcagtggcccaccttcaaaacttgaaaatctcttcaagaaggccacagcattcagagacgccaagtccattgcactgcctgtttatggaggtctttgtcatgctccccacatatacgactctcacgacatcgaggctattgttcaagacgttgtcagttcatcggatcgacttgtttcgcaaaacgaaccaagatttccacttttctcgacaagctccggtactccatacatatcatccagccccgcagaactgatcaagagcgttgtagcagagctcttgacaaaggctattgagtgggacaaagttattgcacaggaggttgaatacgctaagcagaacaaccgaactcaaatcaggctgtcttgctttggcaactccattccattgaatgatctgcgttctgagttgcaaaagacatccaaggatacttctatttccttgaacacctacatgtcggcgcttctcaaggatgctactgagaatgtaaccccccgaggtccagcacaatccaaacttgccattgtgggaatgtcttgcaggcttccaggcggatcaacggataccgagaaattctgggaagtgcttgaagcagggcttgatgtgtctcgccagatacctgcagaccgattcgacatcaatacgcactatgaccctgaaggcaaggatctcaacaagacaatgacgcaatacggatgcttcatcgaagaaccgggaatgttcgacccaagtttcttcaacatgtcacctcgagaggcgatggttgttgatccccagatgcgactctcgcttgtcactgcgtatgaggcattggaacgggcaggctacgttgccaacaggacccagtcgaccaggctccagcgcatcggaacatactacggccaagcagctgacgactatcgcgaggtaaaccaaggacaggaagtcggaacctattacattccaggaggatgccgtgcttttggacctggtcgaattaattacttcttcaaatttgccggtcccagctacagcattgacaccgcctgctcctcaggtctcgcggctatcgaagtcgcttgtcaagctctttggagtggtgaagttgacactgctgtagcaggtggagtcaacatccttacgaaccccgatggttttactggtctcagtaagggtcacttcctaaccaagggccacaacgcctgcaaaacttgggacgctagtgctgatggctactgtcgcgctgatggcgtgggatcgattgtcatcaagaggctcgaagatgcacaagctgataaggataacattcttggtgttatccttgctgcaggcaccaaccattcggcagaggctgtctccatcacccatccccatgcaggacatcaatcatatttgtcgcgccagatcattaggcaggcaggtattgatccgctggacgtttcatatgtagagctccacggtaccggcactcaagctggtgattttgaggagatgaagggtgtcctagacgtgtatgctccaaacacctttcccaaccgcaggtctgatcagaagctacacattggaagcgccaagtcaaatgtcggccacggagaatcagtggctgggactacagcacttatcaaggtcttgttgatgctgcagaagaatgccattcctccacacatcggcatcaaaacagaggttaacccacgcttacctaaggatctggatcagcgaaatgtcgcaatcccgttctccatgaccgaatggaagagtgatggcaagaagaagcgtatcgcggctgttaacaacttcggagctgctggcggcaacactatgatgcttttggaggaagcacctccagtcgtggtggcacgcgagaaggaaaccaggccaacacatgtcatcgccgtgtctgcgaagaccaagacctctttgcgcaacaacatcaaccgtctccttgtgtatctcgatagaaaccctgatgtctccatttcggatctcgcctataccacgactgcgcgcaagtaccaccactcgtacagggtcgcagttagtgctacggatcttgcttcagtgaagaagcaactgtcaacacagcttaacaaggttgattccttgaaacccttgaacaaaaccaacccgccgtcaatggcatttgttttcactggccagggcgcctcgtaccagtcgatggatctcgaactgtaccacgaagcaccagtcttccgagagcacattcaatatctcgacagacttgctcaagcccaaggcttcccttcattcatcccagccttggatggctcccacccacgcgaccacgagcaccctcctgtcatcacccaactagccctggtttgtctcgagattgcgttagcccactactgggcttctttgggcgtcaaacctgatgttgtcatgggacactccctcggcgagtatgcagctatgcatgtcgctggagtcatcagtgcgaacgatgccatctacatggttggttgtcgggcactgatgctccagaagtcatgcactccgggcagccactgcatgatggctgttcgcgcgtctctcgagtctatcatcggcgcatcgaatggcaagccacacactgtggcttgtatcaatggtcccactgacacggttctaagcggcaccaaggcacagatggatgacatcgctgtagatctcgaggcagctgggttccgttgcatcaagcttaacgtggcatttgcattccactccgaacaggtcgacccgatcctcgacgagttcgagacgattagcaagagtggtgttattttccacgagcccaagcttcctgttgtctcaccccttctcggcaaggtcgtctttgacggacggtcgcttaacgccagctacgtgcgaaatgctacacgagcaacggttgacttcctgtccgctgcgaagaacgcttgcgatgtgtcaatcatcaataaagagactgttttcatggagatgggtcctcaccctgtctgtgtcggattcatcaagtccattttcccatcgacaaagaccgccgtcccgtccattcgccgtggagacaacaattggaagaccatctccgagagcgcagcagctattcatctcgatggcgttgatgtggactggaatgagctccaccgtccttttgcggatgcagtgcgtcttcttgatcttcctacatatgcttgtgatgagaagaactattggatacaatacaatggcgattggtgcttgaccaagggcaataccttctacgacaagaaggtcgaggcggcagagcctgcagttggcaataccaagaaatatgagtctttgagctctttggtacagaacatcatttcagtagatgtgaatggagaccagggcactgtgatcatgcagtcggacttaatgcagaaggactttttggctgctgcccatggacactcgatgaacagctgtggtgttgtcacatcgtccatccatgccgaaatcgcatacactctgggagagtatctctaccgcaagttctacccaaagacaaagcgagtggacatgaacatgagcaacttgcacgtaaccagtgccctgatcgccaagaaacactccatggacactccccagtccatccaggtcactgccagtaccaacgacatcaagagtggtactcttgacttgacatggcagaatgtcgaagaagatggcagcctgtcggagccattcgcaacagccaatctcgagtatggcaacgcagacgattggctgtcgagttggagtcccatggcacatctagtccagcaccgtatcgagtctttggagcagctcgctgccgagggcaaggccaaccgcttctctcgcaacatggcctacaccctcttcgcaaagaacctcgtcgactacgcggacaagtaccgcggcatgcaatccgtcgtcatgaacgatctcgaagccttcgccgaagtgaagctcagcgacaaagtcgacaacggaacctacaccgtacccccctacttcatcgacagcgtcgcccatctcgccggcttcatcatgaattgctccgacaccatcgacaccacaaataactactgcgtgacctcgggctggaaaaccatgcgcttcgccgagccccttacccccggcgctcgataccgctcctacgtcaaaatgaccccaaccaaggacgacccctccgtctacctcggcgacgtcttcgtcctcagcgcagcagacaactccattgtcggcatggtcggcggcatccacttccgccgcttcccacgcgtcctcctcaaccgcttcttcaccgcgccccagcccaccaagggcagcgctcaacccgccaaatccgccgcaccacccgctcccagcaagccctccgcaccacctaaagtgcaagcggttcaggcagcaccggtcgtacccgtcgctcctagagaagacgacacccagtcctccgccagcgacacgtccgaccgcgataccccctccgaagcctcagtcaacacatccgctaccagcgtcgatgtgtctgcttctgcgccccgcgctgctaacaccactgttgacaaagctatcgatcttatcgccaaggaaacgggtatcgacgctgctgagctgaccgacgatgcagagtttgccaacttgggtattgatagtctcatgtcgctggtgttgtccgagaagttccagaacgagctgagtgtcaaggtgaatggaagtttgtttttggattatccgacgattggggatttgagggagtggttggagaagtattatgcatga

SEQ ID NO: 166 - DNA, 996 bp, Cochliobolus heterostrophus
atgacggacgataaagggggctacaagcagatcaacaagtcgctcaacatctgcgctttcgaggactatttgaaaggccagaccgcgaacctcgcccctatacctgatgtggagcaagtgacagaaagggttttacgagtgcggggtcaaaatccggggaagttcaccttccaaggcaccaataccttcttagttggaacaggagcctctcgcatattgatcgatacatccggaggagagcctgagtatgcgaagctgcttgcatcaacccttgagtctcggaacattagcatcaagtatgttcttgtaacacattggcatggagaccactccgggggtgtaccggaccttatcagaatgtatccgcacttgaaagatcacatctacaagaacgatcccgatccgggccaacaagatatccacgaagggcaagagttttgtgtcgagggggctactgttgtagcactgcactgcccggggcattcagaagatcacatgtgtttcatgctcaaggaagagaactccatgttcactggagacaacattctcggtaccgggacgagcgcggtcgaagacttgggcatattcatgtccagtctgcacaagatgatggatcagaaatgtcgagctggccaccccgcccatggcgttactattgatgatctaaacacaaaaatcagccgagagctatcgtcaaaatacaggagagagaagcaagtcatcagggccttgcgcaacctccgcgattacgggcaaaaccgaccggtcgttcgtgacattgtcgaaaacatatacggaaactcggtggatgagactacgcgtacgttggcgctggagccgttcatcgacgaagttcttcgaaaacttgctggtgatggtaaagtgggtttccaggttcgcgctggccagaaaaaatggtttctaattggtaatgagcaatcaacggtgggtgggatgcggcaggtccagtaccctgtcacacgcgccagcgcttaa

SEQ ID NO: 167 - DNA, 522 bp, Cochliobolus heterostrophus
atggagaacactctcgttcaagtcgcgcacgcctggggtgtaactggtgcagcgcttttgtcaggcttcatcgtgtgcttcagtcatgccggagtgccaacactcagcgtagctccagtcgacacacttgtgcatcagttcaagaccatgtacaacattggaaaagcgacatcgcctctggtcgccattactgtcactctatgcaatggatactctgcctattgctctagaaacgacaccaatctggtcggcaatgttgcatcaccatttaccttgtacgcagcagcagcgatctttgtacctctgattgtcccgtatacattgctatatatggaaccccaggttaacaagagattgttgacactaggtggaatggtcgagcagggaactaaagcgaaggaccttggggtgagcgatgaggaagttcgagtcatgttgaagaggtggaagggaatgaactttgttcgagcagcacttgtggctcttggtgctgtactcagtgctgtcgcttcatttcgttag

SEQ ID NO: 168 - DNA, 546 bp, Cochliobolus heterostrophus
atggctgctttggatatagcgtttcacatcatacctttcatacattggggcatgattgtatcgttgttcattgtatcgggaatagcatggtccttcaacctatgggtcgtgccgatcattaagatgaacccatcgaaaagcgccatcgcacagctattagagacatcccgacgcggcggagcttggctggagccattgaatgcaagctttgcatttttgtttggtataacggctgctctgatttcgcagcaccctgatccaagtgtagcttcacagtggaagccgtttgcggcctcttttgctacgctgcttcaagtagcatggtgggaaagagtgatgatctttccgcttgagggatcaattgcgaatctaggaaagggcaaggaaaagagcgggggtgctgagggagcttggatggaccatgagaccagcaaggtcctgcacaagtctctggatgagtggtctcgatggcatgcagtccgcgcaacgctgccattgatcggatcgctgatcgcatttgtcacgaagcttcaaagtggggtttga

SEQ ID NO: 169 - DNA, 498 bp, Cochliobolus heterostrophus
atgcctcacaagacagaagtcagaccagctccagcagctacagacatcatcgaatgtcaagctgccgcatttgaatgggctgagagttacgatagcaaagactgggaccgtctttcaagatgcctcgcaccagaactctacattgactaccgcaccgtaatgggaatgatgtgggaaaagatgccagctgcagagttcctcggcatggcttccagccccaggtttctcggtaatgctcgcatcaagacccaacatttcatgggccagacaaagtggatccagaaagaaccaggttacattatcggacaccatcagatgcgtgtagcgcatcaaaagtatgaggatgatgcgctgacgcaggtgctatacaagggtcatgcgcacgggaatgctactttacactatcgtcaagtcgatggcgagtggaagttcgcgggccttgaacctggtattcggtggtccgagggtgattacgcgaagatttttgaacagcattag

SEQ ID NO: 170 - DNA, 732 bp, Cochliobolus heterostrophus
atggtgtcgtatgcagttctcggtgccactggcaattgtggcactgccctcctagagcttctcatcaagaacaccgatgccaaagtcaaagcctactgccgcaacaaagacaagctattcagactagtccccggagccgcaaacaactccagggtcgaagtctacacaggtagcattctagatgccgatctgctcggcaaggcaatgtatggttgcaaagccgtctttcttaccgctaccaccaacgacaacgtacccgggtgccatatcagccaagacctcgcgcacaccgtcatcaaagcgctagagaagacaaagtctgagggaagccaggctccaccgatgccaagactggtattgctgtcctctgctactatcgatccttggatcagccgaaagaacccttgggtcaacgccattgttcgccgatctgcatggcatgtgtaccgggacttggagcttgctgaagagttcctccgaaagcacgaagactgggtcaagtgcgtttatatcaaaccaggaggcttgtcggtagatgtgcagaggggtcacaggctcactttggatgacgaggagtcgtttgtttcatacctcgatattgcggctggtatgattgaaacagccgaggacgacgagggcaagtgggacaacaaaaatgttggcgtagtgaatgcaggtggcaaggccaagtttcccagggtgattatgattgctccgactcccgacgactga

SEQ ID NO: 171 - DNA, 813 bp, Cochliobolus heterostrophus
atgccacacgtagaaagcacaccctccacctacatccccggccgcctcgacggcaaagtcgccctcgtcactggctccggccgcggcatcggcgcagccgtagccacgcatctgggccgtctaggcgccaaagtggtcgtcaactacgccaactcgaccaaagatgctgaaaaagtcgtctcagagatcaaagcgctgggcagcgacgccatcgccatcaaagccgacatccgccaagtctcagacattgtccgcctcttcgacgaagccgtcgcgcactttggccacctcgacatcgccgtcagcaactctggcgtcgtaagcttcggccacttgaaagacgtgacagaagaagaattcgaccgcgtcttcagcctcaacacgcgcggccagttcttcgtcgcccgcgaggcataccgccatctgaccgagggcggccgcatcattctcacttcctcaaacacggcccgcgacttcagcgtgcccgagcactcgctctactccgggtccaagggcgcaatcgactcttttgtacgcatcttctcaaaggactgtggcgataagaagattacggttaatgcggttgctcccgggggcacggtgacggacatgtttcatgaggtttcgcatcattatattccgaatggccttgagtatacggctgagcagcgtcagcagatggctgcgcatgcgtcgccgttgcataggaatgggttcccgcaagacgtggccaatgtggtgggatttttggttagtaaggagggtgagtgggtgaacggcaaggtccttacgctcgatggaggtgctgcataa

SEQ ID NO: 172 - DNA, 4317 bp, Cochliobolus heterostrophus
atggacggccagggcagaccagcccctgtcccgggagaacttgctggcagcgatgtaaacgtatccactcactcctctatgcccccttcacccaccgaaaaacatcagcaaaacgaaatcaaagatttggaagacggtgcagaccagagttcaacaaacactcaggttgagcaatggaggctggccaaagatctcaagtactttgacatcaacagccaagccagcagccgcaagctaggcgtcacatggaagaacctcagtgtcggcgtagttcctgccgacgagcgattcaaggagaacattcccagtcagttcaatcttctacagctcctcaaggacttccgcgcaaaaccagctctgaagactattctcgaatccagctcgggatgtgttcgtcctggagagatgcttctagttttggggcgcccaggctctggatgcacgactttgctcaaaatgctagccaacaagcgtaatggatatgcaaatgtagatggcgaagttcattatggatcgctcgacgccgaacaggccaagcaatactctggtagtattgtcatcaacaatgaggaggaactcttctacccaacactcactgttggcgagaccatggactttgccactcgtctgaacatgcctgcaaacctcgaaggaaatagatccagccgcaccgaggcccgacgcaactttaaacaattcctcctcaattcaatgggcattgcgcacacagagggtacaaaggtcggtgacgcatacgtgcgaggtgtctctggtggcgagagaaagcgagtctccatcatcgaaactctcgcaacacgtggcagtgttgtatgctgggacaactcaacacggggcctggatgcctccactgctcttgaatatgtccgcgcactgcgatgcctgacagacaccatgggaatgtccaccattgtcactctgtaccaagctggcaacggcatctatgacctgtttgacaaagttctcgtcctcgatcagggaaagcagatctactatggctcccgcgaggaggcccggccctttatggagagccttgggttcgtctgtggagatggagcaaatgtcgccgattatctcactggtgtcaccgtgcccagcgaacgacaaatcaaacctggctttgaaaccacctttcctcgcaagaacaccgacatacgatatgcctatgagcagtcgaccatcaaggctaagatggatcaagaactcgattatccctttacggaagaggccaaggtcaccacagaagcattcgtcaaatctgtcttgcgagagaaatctggacatcttccaaagtcatcgcccatgacagtctcgttccccgatcaagtcaaggcttgtgtagtccgccaataccaagtcctatggggagacaaaccgagcctgatcatgagacaagcgaccaatatcattcaagctttgatttccggatcgctcttctacaatgcaccagacaacacggctggcctgttcctcaagtctggcgctctgttcttatctcttctgtttaatgctctcttcaccctttcagaggttaacgactcgttcgtcggtcgtcccatcttggcgaagcagaagaattttgcatttttcaacccagctgctttttgcattgcacaagtcgcagccgatattccgattttgatctttcagacagcttcttttgtcttaatcgtgtactggatgaccgcattgaagcaaactgcggcggcgttcttcatcaactggtttgtcgtctacgtcgtcactttggccatgactgccatgatgaggacgattggcgcaggtttcccctcgttcaactctgcatccaaggtttcgggcttcgccatcaccgcgacaattgtctacatgggatacgaaataccaaagcctgacatgcacccatggtttgtctgggtctactggatcaatcctttggcatatggattcgaggctatcatggcaaacgagtatgacggaaccaccatcccatgcgtctacgacaatctcatcccgaactatctgcctcaataccaggatccaagcgcacaatcctgtgcaggtatccgcggtgcgcgacgcggcgcaacttcgctcagcggacaagaatacctggacagtctgtcctactctccatccaacatctggcgtaatgtgggaatccttttcgcatggtggcttctattcattgcctgcacaatcatcttcacgcttcgctggaatgacacctccagctcgagcactacctacatcccacgcgaaaagcaaaagtacgtccaaagacttcgcgcatctcagactcaggatgaggaatctctgcaaaccgaaaagatcacgcccaacaacgacacgcttggtactacagatggggcaaacgacaagctaggcactagcctgattcgcaacacctcaatctttacctggcgcaacctgacctacaccgtcaaaaccccctccggtgatcgtactcttctcaacaatgttcatggctacgtcaaacccggtatgcttggtgccctcatgggatcctctggcgctggcaaaacgacactactggatgttctcgcccaacgaaagacggctggaacaatcaagggtgaaatcttggttgatggtcgaccccttcccgtttctttccaacgatctgccgggtactgcgaacagcttgatgttcacgatgcttactccactgtacgagaggctcttgaattctcagctcttctccgccaaagccgcgatacccctattgaggagaagcttgcatatgtggataccattattgatctgcttgaactacacgaccttgagaatacgcttattggaaccgtgggtgctggactttcggtcgagcagcgcaagcgtgtcactatcggagttgagcttgtttccaagccgtctattctcatcttccttgacgagccgacctctggtctagatggccaggcagctttcaacactgttcgtttcctgagaaaactcgccgacgtcggtcaagcagtcctggtcaccatccatcagccctcggccttgctcttcgcccaattcgatgttctccttctcctcgccagtggtggcaagaccgtctactttggcgagattggcgacaatgccgacaagatcaaagagtactttggccgctacggtgcaccctgcccccgcggcgccaacccagcagaacacatgatcgacgtcgtgagcggctaccaccccagcggcaaagactggcacgaagtctggctcaactcgcccgaatctgcagccctcaacacacacctcaacgaacttatctctgacgccgcgagcaaagaacccggtaccaaagatgacggccacgaattcgccacaaccttctggacacaaaccaaacttgtcacgcaccgcatgaacgtcagcttcttccgcgacacagcctacttcaacaacaagcttctcctccacggcggcgtcgccttcttcatcggcttcaccttctggcaaatcgggccctcagttggcgaccaaaaatatatcctcttctccatcttccaatacatcttcgtcgcgcccggcgtaatcgcccagcttcaacccatcttcctcgagcgccgcgacgtctacgaaacccgcgagaagaaatctaaaatgtactcctggcaagcctttgtcactgcactcatcgtctccgagatgccgtacctcgtcatctgcgcagtgctgtactatctagtcttctacttcgcctccggcctgcccaccgaccccagcagtgccggcgctgtcttcttcgtcttccttatctaccaattcatctacacgggcttcggccagttcgtcgctgcctacgcccccaacgctgtcttcgcctcgctcgtcaacccgctcctgctcgccgtcctgtgctgcttctgcggcgtcctcatcccgtacgataacatccaggagttttggcgctactggatctactacctcgatcctttcaagtacctcattggctcgctgctcgtgtttaccgactgggactggaagattgagtgtaaggagagtgagtttgccatttttaatccccctggtggcggcaatcagacttgtggcgagtacctcgaggcgtggctccagggcccgggtagacgcacgaatcttgttaatccggaggctacggcggattgtcgcgtttgtcagtatacttggggtagggattaccttgctactgttaatttgacggaaaagtattttggatggagggatgcgggcatttgtgttattttctcgttgagcgggtatgcgcttgtttatttttttatgaagttgaggaccaaggcgagtaagaaggcggagcagtag

SEQ ID NO: 173 - DNA, 957 bp, Pseudogymnoascus pannorum
atgactttccatcccgacactctacccgtcctcaagggcaaagtattcatagtcaccggtgggaactccggcataggctactataccgtatcccacctagcagaacatggcgcccacgtctacatgtgcgcccgatccccaaagaagggcacagaagccatcagaaacatcaagaaaatgcacccctcagccaatatcgacctcctgcaaatggacctcatggacctcaccagcgtcgtcgcagccgccaagttattcatcaccctcgaaacaaccctgcatggcctggtcaacaatgcaggcatcatggctacgccttttgaaatgacgaaggatggttacgaggcccagtggcagaccaactacctctcccactgggttttgacggagcatcttctccctctcatgttgcagacttccaagacgctttctcctggcagcgtccgcatcgtcaatctaacttcatcgggtcacttgagcgcacccaagggcggtatcaatttcgatgatctatcactcaaggacagcggcccatggtcacgatacggacagagcaagctggccaatattctgcacaccaagactctgcaaaattcgtacggccccggttctcccagtgcgcagaacggggggggcgagatctgggtttcgtctgtgcatcccggcgtggttgatacgaaccttgccacatcggtggaggagtccgggacaggcatttcgagtcttctctcaatcatgcgcatggtcggattgatatggcctgcggataaggggtcgtggaatagtgtgttttgtgcggctagtcaggatatgacggcggagcagagcggggcgtatatggagatctttaagcgttttggagagctgaggtgccagagtggtgcggcgaaggatgagcagcttgcggagaggttagaggagtggactagggtggcgatggctgtggtttctaagtga

SEQ ID NO: 174 - DNA, 873 bp, Pseudogymnoascus pannorum
atgccacagttggccgaagcaataagcaaggaagacgactggactgggaccaaggatgctgcagcgcgcagaagggcacagactaggcttaacacaagggcataccgaaaacgcaaagccttggctgcaaataagacaccggttaaatcagaagagctggtagagtgctgggacattaagcagcaatccttctccgtcgtcccagcatcccgtattaaggaattatacaatggcagaagtgccttgctgccggataaacaaagaaaagcccagtttaacattgtcttccctctctgcccagaccacctcattacactcctccaatacaacgccctccgcgctctggctgtcaaccgcactctaatctcaggcatccttgttacgccgctcgactgtggcgaagaaattatccacgtcatcccttacccctccaagcccgaactgctccctttatcacttttgcccaccgtccttcaacaaacggtgccgcacggggactggattgacatgttcccgtgtcccgaggggcgagaccgactaattcgagccgccggcaccttcgacgaggacgagctctgggccgactgcatcggcgggctgttcgaaggctttcccgacgacgaggtcgagcgacgcggcattattgcgtggtcgccgccttgggatatcaccgggtgggagatgtcggaagggtttatgaggaaatggggatggctgttcaaagggttgccggggccgttggcggcgacgaatcggtggcggatgcagagaggcgaagaaccgtttactcatgatgactgcatgtcacatgcaaccgtgttacctttgtgttgtccagatacttcttcgtcatcggatgagctgggtgtttaa

SEQ ID NO: 175 - DNA, 1548 bp, Pseudogymnoascus pannorum
atgttggacttagaatccgacacccaagttgatcagacgcgtaagcaggtatcgtcgcggtcaaagcttcgcgacagctgccatgcctgtgccatttccaaggttaaatgtcccaaagaaaaaccatcatgttcaaaatgcgaatgccgtggcatcacatgccagtacttcttggctaaacgtcctggtcgcaggcgtgagaacaacacagtcaacggcacagggagcaacacaagtcgatgccagtccagcaaaagtcttgcaacaagctccaactccagctccagctccaattccaactctaaccccaataccaaatccaataccgacagcagccggtctatggagtgggaggcacctctagatatgcaacccactcccggaaccggcttgctatcaaaaggaggcacaataattccaaccaattcgtatggcaccgatggctaccttatgacacctttaagcctaagcgtcccggcatctccaagacaagacaatatgttttcaacaaatgcagcacaattttctgtacctggcgaggtcggcatgttctctggtctagtagattttggatctgaggtcaacgacatggatttcatcatgtcggccatggattctccgtttgacctgcttggaatggagtgcggtggcatcactggtagcatcacgcaaacaccaaatgatattgagtcgctcctcatgccaaccgagagagtcgattttgaccatgcttcattggatacgccatcctcacttgatttattgagcacatcgagcgcggcgtcatcaaccgcctccaatatccattcgctgccgactgggatgacgagtatatcggatatcatcgaaacctcaccgtgtggatgtctgatgcaagcactagatctcttgaagaagctttccactagctcaacctcttcccgcacggcatttcccagtctggatgccacggacatgccaagaactgttaatgctagttcagcgcagactgtcgtcttcgaaaataagcaaggcatggaagctgtcagtagcaagcttgcatgctcgtcgtgcgttgacgatggcttcttgctaacagtcatctccatgatcgtgctgaaaatattagaacgatatgccactgtggcgcaggcacagccgcgcaagactggaaaaagcgagccggaaactgacaatccagtgaggctatcgatcagcactacttctggtagcgatgactggatgagagcgccaaatcatgtccttaatggatcgtatgacgacggaggaagcgagcgcgtggccgctcagcttgttctcagcgagctgcatcgcgtgcagaggttagtgaaccagctgtcaccgaaactcaaagggccaaaggagagagaaggtcaaaatatagccccgaagatgaggtactggggccgtcctagggctgcaggagatggtgacagaatgacgttgacttctatcttggctggcaccttggaccaaatggagagggatgttcgcaaaagcttgagtactctgtcagcagagataatcaacgggctacggcaagtttaa

SEQ ID NO: 176 - DNA, 1347 bp, Pseudogymnoascus pannorum
atggatagattgacggaactcaatggtcatagcgatcagctcgcccaagctatcaggagcctcgtcgatagccgtcgaggagccgattcttctgaccagctggggccaagtgctgacactgatgtagacagagatcaatctttattcacaagagccaagtcaaatattctggccagtattgcagcaatcaagtccatagttggtgaaccagcagacttcctccaggatttttctcgccagatcgaaatccttgcttgtcttcggtggctagcggaattccaagtttttgcgtgcatcccgtttgacgaaagcttgcctatcaaggatttggcggacctagtaggagttcccgagagccagttggttcgtgtcatccgtctgactgccacatgcggatttctgcgggaaccgatactaggctttgtgtcccacagccccctctcggcgcaattcatatccaaccagtcattagttgacgctatggtgtttattgccgagttggctactcccacagcattgcagatgccgcaagcaacgcagcgatttggagcctcgtcgagtgccaccgagagcgcatacaacttagctctcaatacggtgcggccgtttcatgtggctatccaagaacgctctaagctgcgtcgtcaatggtcagcttacctttgccatgcagcagggttgcaccaggaggaagaaatcatcgaagtgttatcgcggctcaactggtctaaccttggtaatgcgtgcatagtcgaggtaggggcaaagtcgacctcgatggcaagctctctttccaaaatgtttccaagcttgcggttggtcgtgcaaatcgacaatacacaatcttctttgctagatcgagactacatgtggcaaaatgcagttctggcaagctcaatccgggacagctctagctctggatctagcccttctcccacaaacccttttatcacggttacctatcatgccatgggcatgccgcagtctgtgacagatgctgccgtttatattattcacgtgcctgccacatcctcaggattgacgattaaagcagaactggatgattacttaggtgtgcttcgtaccagcgggggcatcatgcttatcttgacgacacgactgcttcccgagccaggcactcttcccaacccagagatcgaggccgtggcgcgcgcacgggatctgagcatgctccaactggccaacgagagcgagatggagatgtccgagcttctgagtataataaagacggtgggggacaacgctgggaaactcgttgtcactaatcaccttcgctcaaacaatggcgtcatcctagctttaactatcaagtaccaagcatattaa

SEQ ID NO: 177 - DNA, 1002 bp, Pseudogymnoascus pannorum
atggagaacgacaagggcggatataggcagatcaataagtcgttgaacatctgtgcctttgatgagtatcttaaaggtcagaccgcacgactgccgcatatcgagagtattgaacagcttactccaagagtgcttcgcgttcttggccagaaccctggaaagtttacgcatcaagggacaaacacatacatcgtcggcactggccaacgacgcctcatcattgataccggtgggggcgagccagcatgggccaaactgattgactcaacatttatatcaatgaacatcagcctctcatatgttctgctgacccattggcacggtgaccataccggcggagttccagctcttctgcgcctatacccacatctcacgaattccatctacaagaacgaaccggaccaaagccaacagaacatcacccacggacagatattttctgttgacggcgcaacaatccgtgctattcatgtgcctggacattcagaagatcacatgtgttttatcttagaagaggagcaggcaatgtttaccggtgacaatatccttggccacggtaccagtgctgtagaagacctcggcacgttcatggccagcctacagaagatggctgcccaggattgccatatcggttattctgctcatggcgccacagtcaccgacttgccagccaaaattaccggggaattagataacaagttgcggcgcgagaagcaagttatgaatgcgcttggcagagtccgtagccgcggcgagaagagcgtcaccaccaaagacttggtaacagagatctacggcgagtcgcttgacgaagatacgaggatactcgcattggagccatttatcgacgaagtgctacggaaactagcgaatgactgtaaggttgcattcgaaatgaggagaggcaagaagaagtggttctctgtggaggaaatggaggagacaaccacgcagcggtttatggctctgaaaaatccactggccgtaactattcaagtttaa

SEQ ID NO: 178 - DNA, 5400 bp, Pseudogymnoascus pannorum
atgtccgtacataccccaaccacggattcggaatcctacgagggttttcgcaagatggagattgtctattttagcaacgacttccctaaagatgacttggttgacgtttttcgccgcctacacaaccatagcaaggacaagcatttccctgtcttggcccaattcatacgtgaggccacctgggctatcaaggacgaagttcgccaactaccaactgagctcaaacaactgattccgccattcaatactctattggcttgggcggaaaacagccagcttcgggaaggcctaatctgtggggctgtggatggagtgttgctcgtcgtcgctcagctagcaacttacattggatatgtcgagagtcgctctggagatttgtttgacttttcaattacatctcttgctggcctaggcactggcctactatcgtcgagtgccgtctcattgtcgcaaacattggccgacttgccactggcaggcgcagatgcagcccgtctcgccttccgcctgggcattcatgtcttagacatgtcggagaacctggaagctcgtgatttatcagaaagcccagattcgtgggcgtacgtggttcacaatgttgacccgactacggcctacaaggagctagatgacatgcattctcgaatggagatacccaatactggcaaaatatttatcagcgctgttagccggacatcagtcacagttagcggaccaccatcgaggttaaaagcgttgtttaataagtcagagttattccgcgagtcgaaggtcgttgagctgccagtgtacggcggcctctgccacgcgccgcatatcttcggtctggaccatgtacatagtatcgttcacggctgttcattaaacgccgctatcacaaattctccgccagttattccagttttatcgaccagcagcggtttgccatatctggccaagagttccatggagatgtttgaatgcgtcgtctcagagctgctcacgcaaacaatctattgggataatgttgtcagtggcatagtcgaacgagccaagtctaacgttaccgcggaagcagtgcttcactgcttcggcaactccactccccttaacgacctcaatatgaccctgaagagcaatgttccagatctcgacgtctcgatcaacagtcttatgtcatggatctctcaggtttcaccaagagatactacaccccacggcactgcacagtctaagctggccattgtcggtatggcctgcagatttccaggaggtgccacaaatactgagaagttttgggagatcctagagcaaggccttgatgtctcacgtcgagttccagctgaccgctttgacatcgacacacactacgacccaaccggcaagcagcagaataagaccatgacacagtttggctgctttattgatgagcctggtttgtttgatgcgcctttcttcaacatgtctcctcgtgaatctcaggccgtcgatccgcagatgcgtttggctcttgtaacggcatacgaggcactggagcaagctgggtacgtcggtaatcgcacagctgctacacagttgcaacgcattggaacatattatggacaagccgccgacgactaccgtgaggttaaccaaggccaggatgtaggcacatactatattccaggcggttgccgtgcgttcggccccggtcgtatcaattacttttttaaatttgcgggtccaagctacagcattgatactgcttgctcttccggacttgcagcgatcgaggtcgcttgtcaggctctttggaacggcgatgtagatatggctgtcacgggcggtgttaatgtgctaactaacccggatgttttcgctggcctttgcaagagccatttcctaactaaaggtcacaacgcatgcaagacctgggattctaccgctgacgggtactgtcgtgcagacggcgttgggtctgttgttattaaaaaactcgaagatgctgaagcagacaacgacaacatcttgggcgtcattctcggtgcgggaaccaaccattctgccgaggccgtctctattactcaccctcatgccggccatcaggcgtatctgtctcgtcaggtgcttcgccaggccggcgtggatccattggatgtttcctatattgagctccatggcactggtactcaagctggtgaccacgaggagatgcaaggcataatggaagtgtatgctccgctcatcaagcgacgtaggaaggaccagcccctacacattggtgctgtaaaagctaacgttggccatggtgaatctgttgctggcacaacggcattgatcaaggtgcttatcatgctccaaaaaaaatctatcccgccacatatcggaatcaaaacggagatgaaccccagattcccccgagacttcgacaaacgcaacctccacatcgacttggaaatgacaccctggccgcaaacatcgtctaagaagcgacttgcagttgttaataactttggtgccgctggcgggaacacgactatggttttagaggaggcaccaactcgagacatatccgaggccgatccacgcaatactcatatcatcgccatatccgccaagactaaagggtcattaacaggaaatattgagcgcctgatcgcccaccttgatgcgaatccagatatcaaccttgccgacctttcctacacaacgactgcacgtcgctcccatcacagccatcgtgtagcaattgccacttctgatataggccacctaaagaagcagcttacttcccgcctagaaaatatcgattcaatgaagcctattggaaattctggtagtccaccagtagctttcgcctttactggccagggctcttcttataaatcgatgaaccttgagttgtaccacgatgtaccaacattcagagagcatattcagcatcttgattctctcgctcgacgccaaggctttccatctattattcccgctctagatggctctcatcctaaggaccacttgcactctccggtagtcacccagcttgccctggtatgcaccgagattgctttggcaaaatactgggtttctcttggaatcaagccagacgtggtcatgggtcacagtctgggcgaatatgctgcgatgcacatagctggtgtggttactgcaagcgacaccatattcatggttgggcgtcgtgctcaaatgctagaagaaaagtgcacgattagcagtcatagtatgatggcggtccgggctactcttcagcaaatagaggaatgcttaggaacaaagccgtatacgattgcttgtgtcaatggaccttccgatactgtcctcagcggtactaaggagagtacagatgatgtcgctgtggtgctcgaggcggccggttaccgttgcttcaagttggacgtcgcgtttgctttccactcagagcagaccgatcctattttggatgacttcgaggagatatcaaagactggagttgtttttcaggaacctaaacttcctttcatctcgccattgctcggaaaggttatttttgacagtaagacgctgaacgcaaactacgttcgccgagccaccagggagcctgttgacttcttgtctgctttgagaaatgctcaaaagatttctaccattagcgatgaaactgtctggatcgaaattggaccacatcctgtctgcactaactttgtcaagactaccatcccgtccacgaagcttaccatcccatcgatccgtcgtggagataacaactggaaaaccatggctgaaagcatggctgctctgcatcttgctgggtttggggtcagttggaacgaattccaccgcccatttgagcaaaggctgcgccttttagacttgccaacatacgcctggaatgacaagaactactggttgcagtataatggtgactggtgtctgactaagggcaatactttctacgatgccgagaaggaggctgccagagcaaaatctgtactaagatcgctgcctgcgagcgggtttctgacaacgaccgtgcagcagatcatcgacgagtcttttagcgattttgctggcacggtggtgatgcagtctgatcttatgcaagcggatatgctcgccgctgctcatgggcacagcatgaacaattgcggtgttgttacatcttccatccacgctgacctcgcctacaccctcggcgactatatataccgcaagttctatcccaaagccaaggaagtcaatgttaactttgccaacttggttgtcgcaaaaggccttgttgcccaaaacagcaacaagactccccaattgttccgtgtaactgctgtcactgccgacgtccgctcaggcgtggtcgacttaacgtggcagaatgttgacaatgatggctatgcccacgagccatttgcaaccgccaacataatctatggggattcatctgaatggatttcatcttgggcctcattaggtcacctcatccacggccgcatcgaagcgcttgagcgcctagctacagagggaaaagccaaccgtttctctcgcaaaatggcatacacgatctttgccagtaacctagtcaactacgctgagaaataccgtggcatgcaatctgtggtgatgcatgaactagaagggtttgctgacgtgcaactgaccacaaaggagagtggagtctggacagttccaccatactttatcgacagtgtggtgcacttggctggctttatcatgaactgctcggatgccattgatacaaagaataactactgtgttactcctggttggaactcgatgcgattcgcgaagcctctgcttccaggagccaagtatcggtcgtatgtcaagatgattcctacagtcgaggatccgactatttacaatggcgacgtgtacatcatgcaagatgataccatcatgggtgtggttggtagcatacagttccgcagatatccgcgcatccttcttagccgctttttctcgccgccagacaagatggccaccttcgatgtcaagccaaaggggcaggtggctgcccccaaaactgcggtcccagcacaagatgcaacaaaatttgatgcaaaagtgtcactcccgatacttgctcgcggtgcatccgaacctgacagtgacgacaagcagggcaaccctcctgcccctgcactgcctgcccccgatgccgccgccccatctatcgttgaatccgcggccgcttccggcactacaactgcaaaggcaatcatgctcattgccaacgaggcaggcctagaactttctgagatgtcagacgacgcccttttcgttaatttgggaattgacagcttgatgtctctagttatcgcagaaaagctcagatcagagctagaagtcaaggtcagcggcagcctcttcttggactacgagactattggtgatttacggcagtggttggatgagtattatagctag

SEQ ID NO: 179 - DNA, 1014 bp, Pseudogymnoascus pannorum
atggacgccttcagagactctactcctcaggaatctgcctattccgcccctcaggttgccgcctggctcggtcgcatctccctcccctcatccctaacccaatacgtggattctccgtcagcctttcctaagacagccacatccctccagtcgctgttccgatgccagatcacaacctttccttacgagaatctctcagtgcactactcccagagccaccaggtcaacatccagccagatgtgctgtttacgaaaatgatgggcccggatcataacggcaggggcggctactgcatggaacttagcatcttcttccaccacatgctgcgcgggcttgggttccacgtctacatgacgggcgtgcgcaaccggacgcggactgacggcaagccgcagggcgaatatcaggggtggacgcacattaacaacatcgtccacctcccttgcggctccaagtttagcgccgacgtcgcgtttggtggtgacgggccgacgtctcctcttcctatggatggcatggcatctgcgcttcgcaatctaggaacccaagaggtacgcctcatacaggaaaacattcctaagcagcgccttcgggagccgaagttgtgggtgtaccagtatcgcaacagttctgataaggagtggaactcattctacagcttttctgagatcgagttctttcaggaggattttgaggttcagaattggtggactagcgctaagacactccatcggtggactgtgttagtggttcgatttctaagggagggtgagcccattaaattctctagagatggtgcctggaggaaaggagatgaccaagagataagcattgtcggcaaggtaatgctagtaaataacctggttaaggttaatgtaggggggaagacaagggttgtacatgagtttaattccgaggatggacggttgctggcactccaggagtattttgggattacattaacgcaggaggaggcccagttcatacaggggtgggacatggcgctaaaatag

SEQ ID NO: 180 - DNA, 921 bp, Pseudogymnoascus pannorum
atgcttgttcttattgccggaattactggaagccttggcaagcgccttgctgaaattgccattgcacgagggctgtctgtccgcggtttaggccgcaaccccgacagccttggtcctgaaatatcagaacatctggaatcctttgtcaaaagcgactcatactatgacatcccagctcatgagaaagccgtcgccggagtcgatgcggtgatcaatgcctattctccaatccctatgctagatctcgacggccaccttcttctcattcgcgccgcagagcgggcccaaattaaggtgttcgtcgcttcctcctggagccgtgactggaccaatatcaagttcaatgatttcgagcattacaacaaccatcttgctttcgagcatcagatcgcgacgaccagcaccatccgcccagtctacatacttactggtatcttcacagaccttctattcacgccttacgggcctggaggatttgatacgagcggcgacaggccgcgcatgcgctactggggcaacgagaacaccaagagcaaatggccttggagcacccaagacgatgccgcatcgcgcacaattgatattttgctctatggcgacggcgtccaagctgggaagggcggctttttcaaaattcgctctggagtgacgaccatcgaggagctcgcggtggtatacgagaaagtctttggggttaaagtcgacattactcgcgcgggtagcgtggatgatctcgagaaggaacttgctcggctgagagaggagaagggcaggactgggtatggtgagtacatggctgaagctgcagcattgattgcaagcaagggattgtgggaaaacagggacctcactgtcctggaccagtttaaaaaatccccaacgctcgaggaacacttcacggaagtgaaaaacaaggcctaa

SEQ ID NO: 181 - DNA, 2289 bp, Pseudogymnoascus pannorum
atgagcaccaacagcatcaagaaggcaagtagccgcagcaacagaggcccaaaatgggacgatgttaaaaaatgcgaaagactagttcctgaaacgtcaaaaaagccagaatcaggatctcttcccacatcgcagaatgtgaccatcgataccacgaactcccctggttctgaacatcctggtgtggcctcatctgccgtatcacctcaagcaaaaccgattgttacaccttctgcagaagacagggcagtttcagaggcaatagacgcaatagaggacctcacaaccgactttgacgcgaccagcactgaggcaggtcccagtaagcggacccaaaaagccaccgaaaagcgaaataggaaaactcttaagtcagacactactgctgcaatttctcaaaagaaagtgtctcaaactcgatctgttaacgacagtcccaataacaactaccaaggctcgttcccaaccgatgatgcttatgagaatagtcctgcatcatccgagtcatctctatggggggacgaccagtcatggaataccccaaactacctcagctttgatccagcaaggctcttggtatatcaaatgaaaccacagcgtaaaacaatgcgccagcggctttcttccataaagcagaaagccgttgagattgcaactgacgtggattgggtgaaagacgccatggccagcatgcgtatcaaaaccggcgcggaaagtcccagaaataaagagaagagtgccaaaaactcacgcaaggattcaaaggacacatttgatgtgatcttaagaggtgggttcggcgatattttgggcttgaacggcggaggaaatgatatttctggctttggtgaagggagcgatacctgttgtgctcagctttcagccggtttgggatcctcagtggttttcaattcaagcagcgcgtatgccaaatcacagagttcgtattgggcgttgcaacagtcagaactcatcccaagctgcattgttgtgccatcgacagcctccgaggtgtcagacgccatctccatcatttcaaccatcgaatcatgccactttgcagttaaaggtgcagggcatggaactgttgttggagctgcaaatattgatggaggagtcaagtttgatatgagccagctcaacgaaatcgagaccaactcagagggaactgtcgccagaattggagctggaagtcaatggggagaggtctatgagtatcttgacaacagaagcctttccgttgccggcggccggaacggcgatgttggcgtagctggtgtgctcctcggaggtggcatatcattttatggcccgcgagtaggctgggcaaccgataatatcttaaatgtcgaagtcgtgcttgcctcgggagagatcgtcaacgccaacgccacttccaaccaagaccttctgaaagctttgaagggaggaaacagcaattttggcatcgcaacatcatttgatctgcgcacatttcctcagggggaaatgtggattggttatctcggccaatccatcaatagtcgcgaggaagttttccaagctatcagcgatattgcgtcgaatgcaaataaggacccttttgctgccttggtgggcgatttcaagtttaattccgccaccaaatcttgggtcatgaaccatactgtggcatacacaaagccagttgccaatccgccaatctttcagccgttggtcaatattaagccccaattgagcaacaatattgcaatcacaaacatcagctctattgctctggggcagaagatgggcgccaaagttgcgtacaataagaatcacctgtcttacacaggcacatacggcaacgatgcagcacttctctccaagatttttgacattagcaacgccaccgtccacaagattatgccgcagatcaatggtggcatcaagtgggttacaatgatggagccatttccagcgcttgtagacagtttcggagaaaagaatggcggaaactcactcggactaagcgctgacactggagaccgtattgtcatcctacaattggcgcaattcgaaggccacggcgcgaacgacttggtcgacacggaactccacaacatgttcgatgagatcgcgagcgtggcgtcggagatgggactcttgcgccggttccggtacttaaattatgccgacaagcaacagaaccctatcgcttcatacgggccggagaatgtggcgcaattgcaagccacgagcaagaaatacgatccacacgggctgttccaacgacaagcgcctggcgggtttaagcttggaatgcagtag

SEQ ID NO: 182 - DNA, 456 bp, Pseudogymnoascus pannorum
atggctacgctggatgagtcagggatgcctaagttgtcagagtcgacaaaagacggctatctgtgccttaccgtttgtgggtaccgtaaaccaggcatgaacgaggaagattaccgcaattacatggtcaatgtcttagcgcctatggccagggaccttatggtgaagtacgatatcaaacgatggacccagatccacaatcaaagcgccactcgggatttaatgaaccagctatctgatcatcagatgaacaatattgcagacttcgactgtttcagccaggtggttttcaagagtattgaagacttcaagcgtatgaaacaagacccatggtacaaggagcatttaggcaaccacggaagttttgctgatacgaagcgaagcaaggtgacaataggctggattgaagaatttgtgagagatggtgaggtagtcgatggcttcaagatttgctag

SEQ ID NO: 183 - DNA, 2790 bp, Pseudogymnoascus pannorum
atggacgaggtgagatatcgcgaccagctcgccgcagccgtcaagagcctcatcgatagctgtcgaggagctgattcttccgaccaactggcggcaagcgctgatactgaagaaaacaaggactatgcttctttaaacagagccaggtcaagtattcttgccagtactgcagcaatcaagtcactagttgctgaaccaaaaaacttgcttcaggatttcgctcgtcagattgagatccttgccagtcttcggtggctagcagaatttcaggttttggcgtgcatcccgtttgacgaaagtttgcctgtcgaggacctggcagacttggtaggagttcccgagagccagctggtccgggttatccgtctgacggccacatgcggctttttacgagagccaatatcgggttttgtatcccacagcgctctctcggcacaattcataaccaatcagtctttacttgacgccactgtgtttattgccgacttggccactcctacagcattgcagatgccacaagcaacgcagcgctttgggaattcctcgagtgccacagatagcgcatacaatttggctttgaatacggtgcgaccgtttcatgtggctgtccaggagcgctctcggctgcgccgccaatggtcggcctacctttgccacgcagctgggttgcatcaagaagaagagatagttgacgttctatcgaagctcaactggtcaaaccttggaaatgcatgtatagttgaggtcggcgcaaagtcaacttcaatggcgggttctctttccaaaatgttcccaagcttgcgattcgtcgtgcaaattgacaacacaagatcttatttgttagatcaggactacgcgtggcagagtgcagttctaggaggctcgacccaagatagctctggctccgggtctagtccttcccccacaaaccctttcgtcacggtttcttatcgcgccatgggtatgcctcagtccgtgacagatgctgccgtatatataatccacattcctgtggcatcatccggattgacaattaaagcagagctggatgattatttgggtgttcttcgagccagcggaggtatcatgctcatcatgacggcacggttgcttcccgagccaggctcactctccaactcagaggctgagagtatggcgcgcgcacgggatctgagcatgctacatctagctaacgagggtgagatggaaatttccgatctcctgagtactataaagacggtgggggacagcgctgggaaactcgttgttactaatcacctacgctcaaacgacggcataattctagctttaaccatcaagtatcaagcttacattattcataagcctacattcgatagtagatcaccagcatttacctccgacacactcccgatcgttggctcctggaactattttacccagcacaaaaatttttggaaggactgcgtcgcagagtctaagaacggccactttagtttttggatcggcaagaaccatatcattggcctatctggcgcggctgctcgcaagatgtatctagacagccgcgatctcgatcctattggagggtctatgcttattgggcatggaccagacattatagatggtaaatcatccattatacctgccatctggacgactaccgtaaccggcgaccgtctctttgcccatcgccggcttctcgatttgcaaaaatcggaacagctcacgaagcgcctcgctcgtgtgaccaaggactgccgcgacacatttagttcaatgtctacaaactcgtttggggtcataaatccaactaagtcgtgctatcccattgttgtgaagcagtactctcgcattgtgggcgccgatgaaatctcgaataacccaaagatgctagaaaagctccaatattacatgcatatcctacagaccacttcaagtgtccatctccttgcttttccttggctgtcatactttagtgtggcctattggaaacgtcgctatggccgttgggggttttctaacattgtgacgcctattgtcaacaagcgaatgatgaagggcgcacttcgcgttgatgatgcgctgcaacttcttattgataatggcgacagcaaaacctatattatcgacttcctcattagcatgttatttatcgccggtgccaacgccactgttttaaccggtgccatgctaaatatcatcgcccaccacccagactggcaagagagaatataccgtgagattaaggctaccgctgcatcccactcaacgaacaaaggtgcatcattggtagaccaactcgactcaatgccattgtccgcctgggaatcactttctcagtctcttgaactttgtttcaaggaaaccatccgcatgtgggctgttttcccagtaagtcgcagaaatatcaccgatcatattataaatatcgcaggaacacacgaggttatcccacctggtggctatactgcatatcatagcactgatgtacattataacgaaaacctctacccggatccgatgagatgggacccggaacgcttttgcgatggtcgcgaagagtttaaaaaggaggattatggatatattggttggggtcagggacgtcatccttgcattggcatgcgttgggctaaactccagcaaaatataaatatcgcctatcctctagctatgtacaagtggagcggctgcgatgagaatggacagcccaaccctaactttgcacataagccaacagtaaacagaggcgcccccactctgccgatgggactttactgtaaatatgttccgcgaggagatacataa

SEQ ID NO: 184 - DNA, 1020 bp, Pseudogymnoascus pannorum
atggatacttttactatgaaaaaggacaaaggtggttacaggcagattaataaatcgttgaatatctgtgccttcgatgagtaccttcggggccaaactgcgcgactaccgcatatagagagtgttgaacagctcactccgagagtacttcgcattctcggtcagaacccgggaaagttcacgcatcaaggaactaatacatacatcgtcggcaccggccaacgccgactcattatcgacacaggtggcggccagcctgaatggaccgaactaatcgcgtcgacttttaaatcaatgaacataagcttatctcatgttctgttgacccattggcacggtgaccacactggtggtgtctcaggtttattgcgcctgtatccgtatctcacggcttcgatctacaagaacgagccgaatcagggccagcagaacatcgctgacggacagatattctccgttgatggcgcaacaatccatgctatccatgcacccggacattcagaggaccatatgtgttttatcctagaagaggagaatgcgatgtttaccggcgataatatccttggccatggtactagtgctgtagaagacctaggcaccttcatggccagcctcgagaagatggccgcccagaattgtcaaatcggttattctgctcatggcgctacaatcgcaaacttgccagcaaagattgctggagaattagaaagcaagtggcgacgagagaagcaagttatgaaaggactggcgcgagttcgcatccgtggcgagaaaagcgccaccgtcagggacctcgtaactgagatctacggcggttcgctagacaaagacacgaggacgctcgcattggaaccatttattgatgaagtgttacggaagttggcggatgactccaaggttgcttttgaaatgagaggaggcaagaagaagtggttctctgtggaggaggtggaacaaacaaccacctggcggttcacagccacgaataaaagttcaccagctgtacctgttcaagtttga

SEQ ID NO: 185 - DNA, 5415 bp, Pseudogymnoascus pannorum
atggccgtgcttaccccaaccacggattcggaatccgacgaggagtctcgtaagatggaagttgtctattttaacaatgagttctcaaaggaggacctgcaggatgttttccgccgtctacacaaccacagcaaggacaaacattaccccgtcttgacccagttcatccacgaggcctcttgggttataaaggacgaagttcggcaactgccgactgagactaagcagctgattccgccattttctaccctcctggcttgggtggagaatacccagcttcgggaaggactactgtgcagcgccgtagatggagtgttgctcgtctttgtccagctcgcagcttatattggatatgtcgagagccgctctggagatttgcctgattttccaactacatatcttgctggtctgggcaatggcctactatcatcaagtgccgcctcattggcacgaacattgggagatctgccattggcctgtgccgatgcggttcgtctcgccttccgactaggcattcactctcttgatatttcagagaatttggaagcccgcgatttatcagaaagcccggatccatgggcgtatattgtccacgacatagatccggctgcggcttataaggagctagatgctatacattcccgagacgagacccctaatacaagcaaaatatttgtcagtgctgtcagccggaattctgtcacaattagcggaccaccttcgaggttaaaaacgctgcttaataagtcggagtttttccgtgagtcgaaagtcgtcgcaatgccagtatacggcggtctctgccacgcgccgcatatattcggtctggacgatgtacatagtgtcgttcatggctgtgcattaaacgccacggccacaagttctccgccggcgatgccggttttatcgacgggtaccggtttgccgtacctggcaaagaattctgtggagatgttcgaaggtgtcgtctcagaactattcacgaaaacaatttgttgggataatgttgttagcggcatagtagaacgagtcaagaccaacagcaccgcggaagtaatgcttcactgttttggtaattctacccctcttaatgatctcatagttgcattgaagagcaatgttccaaatgtcgatgtctcgaccaataacctcatgatgtggatctcgcaggttgttccaagagatgctaccccccgcggcaccgggcagtcaaaactggctattgtaggtatgtcatgcagacttccagggggcgcgacaaacaccgagaagttttgggagatcttggaaaatggccttgacgtctcgcgacgaatcccagctgaccgcttcgacattgatacgcactacgaccccactgggaagcagcagaacaagaccatgacacagtacggctgctttattgatgagcccggtttgtttgacgcacccttttttaacatgtctcctcgtgagtctcaggtcgtcgatccgcagatgcgattagctcttgtcactgcatatgaagcactggagcgtgctgggtatgtcggtaatcgtacggcttccacacaattacaacgcataggaacatattacggacaagctgcggatgattaccgtgaggtcaaccaaggtcaagatgtcggcacgtattatattccgggtggttgccgtgccttcggtcctggtcgtatcaattacttttttaagtttgcgggacctagctatagcattgacacagcttgctcctctgggctcgcggcgattgaagttgcttgtcaggctctttggcatggcgatattgatatggccgtcactggcggtgttaatatattgactaacccggacgggttcaccgggctatgcaaaggctatttcttaaccaagggtcacaacgcttgcaagacatgggattccactgctgatgggtattgtcgtgctgacggaatcgggtctcttgttattaagagactcgaagacgctgaggcggacaacgacaacatcttgggggtcatccttggagcaggaaccaaccattcggccgaggccgtctctattacccacccccacgctggccatcaagcatatttatcccgtcaggtgcttcggcaggccggcgtggatccattagacgtgtcatatgttgagcttcatggtaccggtacacaagctggcgatcacgaagaaatgcagggcataatggaggtgtatgctccactaataaggcggcgccggaaggatcagcctctgcacattggagctgtcaaggccaatattgggcatggcgagtctgttgcaggcacagcggcattaatgaaggtgcttctcatgctgcagaaaaattccatcccgcctcatattggtatcaaaacggagatgaatcccagattcccccgagactttgacaaacgcaatctccatattgacttggagatgacaccttggccccgaattccgtctaagaaacgactggcggttgtcaataactttggtgccgctggcgggaacacaacaatggttttggaagaggcaccaactcgtgtcctatcggaggcagatccccgcagtactcatatcatcgccatttcagccaagactaaagcatcgttggcaggaaatatggagcgtttgcttgcctatcttgatgaacacccagatattaaccttgccgatctttcctatacgacgactgcgcgccgtactcatcatacccatcgtgtagcaattacaacttccgacatgggtcacctgaagaagcagttggctgttcgcctagggaatgtcgattcgataaagcctgttgatagttctggcccgccaccagttgctttcacctttactggccagggttcttcctacaagtcgatgaatctcgagttataccgtgacgtgccaacattcagagagcacattaagcatctcgactctatcgctcaacgtcaaggctttccatctattgttcccgctctcgatggctcacatcccaaagagcacgcgcactttcctgtcgtcactcaacttgccttggtctgcaccgaaattgctttggcaaaatattggatttctctcgggatcaaaccagacgtcgtcatgggtcatagcttgggtgagtatgctgcaatgcatattgctggcgtggttactgcaagcgataccatattcatggttggacgtcgagctcagatgctggaagaaaaatgcaatattaacagccatagcatgatcgcagtccgggcttctctacaaaaaatagcagaaagcttgggagaaaagccatacacaattgcttgtgtcaatgggccttcagatactgtgctcagcggcaccaaggagaatatggatggggtcgctgagttactcgaggctgccggttaccgctgctttaagctggacgtcgcgtttgctttccactctgagcagactgatcctattttggatgactttgaggccatctcaaagactggtgttgcctttcgtgagccgaaactaccagttatctcgccattactcggaaaggtgatttttgacagcaagacgctaaacgcaaactacgtccgccgagccaccagggagcctgtcgactttttgtctgctttagaaaatgctcaaaaaatctctaccattagtgatgaaactgtctggatcgaaattggaccacatcctgtctgtactaactttgtcaaagccactatcccgtccacgaaacttgccgtctcatcgatgcgccgtggagataataactggaaaacaatggctgagagcatggcttccatgcatcttgctggattcggggtcagctggaacgaatttcaccgcccatttgaaaacaggctacgccttttagatttgccaacatacgcttggaatgacaaaacctattgggtgcagtataatggcgactggtgcctaactaagggaaatactttctacgacgctgagaaagaggctgccagagtaaaggctgcgacaaagacgctacctgcgaatgagctttacacgacaaccgtgcagcaaatcatagatgagagtttcaacggtttctctggcacagtggtgattcagtctgatcttatgcaaccagacttacttgctgctgctcatggacacagtatgaacaactgcggcgttgttacttcttctatccacgccgacctttcctataccctcggtgactatatataccgcaagatataccccaaagccaaggacgtcagcatgaatttttcggacctggttgtcacaaagggacttgtcgctcaaactaacaaacaaattccccaattgttccgagtaactgctgtcgccgccgatgtccgctcaggtgcggtcaatttgacgtggcagaatgtgaataatgatggaactgcggacgagccatttgcaactggtaaaatactatacggagattcaactgagtggatatcatcttgggccccatttgctcacctcatccatggtcgcatcgaagcgcttgagcgcctagccgcagaaggaaaggctaaccgcttctcgcgcaatatggcatacactctctttgccagtaacctagtcgactacgcagagaagtaccgtggcatgcagtctgtagtgatgcatgagttcgaagggtttgctgacgtgcagctaacaacgaaagagggcggagtctggacagccccaccgcacttcattgacagtgtggcgcacttggctggttttattatgaactgctcagacgccatggatacgaagaataactactgtgttactcctggttggaactcgatgcgatttgctaaacctctgcttccaggagccaagtatcggtcgtatgtcaagatgattcctacagtcgaggacccaacggtttactttggcaatgtgtacatcatgcaagacgatgccatcatgggttttgtcggtggtattcagttccgcagatatccgcgcatccttctcagccgttttttctctccgccagataagatggcctccttcgaagccaagccaaagggacaggtgacttcttcaaaaactacggccccagcattggaatcaacaaaaactgttgcggtagaatcaaagccggtcctctctggcggtgaatccggccttggcagcgacgaaaagcaggggaacgctcttccttccagctcctccgcccccacgccacttgctcccgaggcctcggcgccatctatccctgattctgcggcagcttccgatactacaacggcaaaggcaattacgctcattgccaacgaggctggtctggatcttgttgacatgactgacgatgccgttttcgctaatttaggcgttgacagcttgatgtcgctggtcattgctgaaaagctcagaacagagctagatgtcaaggtcaccggtagccttttcttggactatgagacaattggcgatttgcggcaatggctggatgattattatagttag

SEQ ID NO: 186 - DNA, 2298 bp, Pseudogymnoascus pannorum
atgaataccaccaacattgcccgtggggcaaatggacacgtcaaaataagctcgaaatgggacgagattacagctgtcgaccgagaaacgtcagaaaagctacgattggggcttctaccctcgtcgaagaacatagacatcaatattctaaactctcctggtattgtatatcctagtgtatgctcttcttccgctgtatgtcaagtaaagactgtcactacaccctctgcagaagacatagcggtttcagaagcaatagatgcaattgaagatcttacaagcgactttgaagctgtcacagatgagagcaataccgaggaagttccaagtgagctgactccaaaggtcaccaaacggaaaaatacacgagtttccaagctaaaatatgccgcggaaccttctcaaaagacccaatggccccgaacctggttaggtaacgacagcctgtgcaacgacaagtctagtcccaagaccatcgaatacggctgcaagaatagtcccgcatcatctctgtggacagatagcgaatcttgggatactccaagcttcctcagatatgatgcagaaaggccctcacggtatcgatttgtgcggccgcgcgaaacagttcgccagcgagttacttcactgaagcataaagttgttgaaattgcgagaactgatcttggctgggtgaaagaggccatgggcaacattcgtaccaaagctagcccggaaaatcccaaccatagagttggaagtgccgaaaactcacgcgagagttcaagagacgactctacttatttgagtctgaggggcggagcgggcgatatttcaagcttgaacggagcgggaaatgacatttttgggattggcggggggactggtgattgttgtgctcaactttctgcagagttgggatcctctgtgggttttgaattgagcagcatctatgccaactcgcagagttcgtattgggcaaaacaacaatcggagctcactccaagctgtattattgtgccttcgacggcgtctgaagtcgcggttgccatctccatcatttcaacaatcgagtcgtgcaacttcgcagtcaaaggtgcagggcacggaacagttgtgggagctacaaatatcaatggaggtgtcaagtttgatatgagccgcctgaacgaaattgagaccaactcggaaggaactgtcaccaggatcggggccggaagccaatggggagaggtctatgagtatcttgacaacagaggcctttccgttgctggaggtcgaaacggcgatgttggcgtagctggagtgctccttggaggcggaatatcattctatggtccccgagtaggctgggcaacggataatattttgaatgtcgaagtcgtgcttgcctcgggagagattaccaacgccaattccacttcaaaccaagacctacttaaagcattgaaaggcgggaacagcaacttcggtatcgccacattatttgatctgcgcacattcccccaaggtgaaatgtgggtgggttatctcggtcaatccattgatagccgcgatgaagtttttaaagccatcgccgatatcgcgtcaaatgccaatgaggaccctttcgctgctttggtgggcgacttcaagtttaattccgccaccaaatcttgggtcatgaaccatactgtggcatatacaaagccagttgccaacccgccgatatttcagccattggttaacatcaagccccagttgagcaacaacattgcaatcacaaacattagcaccattgctacggggcagaagaatggagccaatgttgcttataacaagaaccatctgtcttatacgggcacgtacggaaatgatgcggcgcttctctccaagattttcgacatcagcaacgccaccgttcacaagataatgtcgcagaccaatggtgggatcaaatggacaacaatgatggaaccatttccagcgctggtggacagctttggagataaaaacggcggaaactcactcggtttgagcgcagagactggagatcgtattgtcatcttgcaattggcacaatttgaggacagagatgcgaacgacatggtcgacaaagagcttcacaacatgtttgaggagattgcaaaagttgcatcggaaatgggactcctccgccgctttcggtacttgaattatgcggacaagcagcagaaccccattgcctcatacgggccggaaaatgtggcgcaattgaaggctacaagcaagaaatacgatccgaagggtttattccagagacaagcgcctggtgggtttaagcttggaatgcagcagtga

SEQ ID NO: 187 - DNA, 2097 bp, Pseudogymnoascus pannorum
atggttgcccctcctccagactgggtcgcgaagttgacgccctccgggccgcagggcagtgagctccttgcaacggagcgtgcgaagagtaacatcaacgttgagaagctgtccaacttcatgttcggcaaggaggcgctggagaacgaggccaagatcctggctatcctccagtccgagaaggtgttcgacaagtcgaacaatgccttcctgggaagagtggagaagttcccggttgctctcgccagagcgaagaagctgagacagctgcaagtcaagcacaactggagcaccgaggactacagaatcgccgatggcctgatctccgagccaggcccatacgggcttcacgcctctatgttcttgactgctctcagagaccaaggaacttcggaacaacacaagctcttccttgagccggccgagaactacaagtacatcggctgctacgcccagaccgagttgggacacggctccaacgttcgtggtcttgagaccaccgcgacctgggaccctaccgacaagaccttcgtcattcactctcctcatcttaccgcctccaagtggtggattggctctttgggccgcaccgccaactacgccgtcgttatggcacagcttattctcaacggcaagtcctacggaccacaccccttcgttgtcccagtcagggacttgaagactcaccagccccttgacggcgtctacgtcggagacattggaccaaaattcggttacaacaccatggataacggtttcctcctcttcaacaaggtcaaggtaccccacgtcaacatgttggcaaagtactccagcgtcgacccaaacacaaacaagtatgtccgcccagcagctgcgtcgttggtttacggaactatgacctgggttcgctccaccattgtgcttcaatccggccagaccctggcaagaggtgtcactatcgccaccaggtattgtgctgttcgcaggcaattccaggaccgcgatgacatctccaacgatgtcaccgagaaccaagttctcaactacagcatggtgcaattccgtcttctccctctcctcgcttccaccttcgctctccacttcactggcaaggccatgatggaaatgtacgcacaaaaccaagagaggatgaagaaggctgttgccaacaccaggagaggagccggcccagaggagcttcagtctggcagtgatatgcttgctgatctccacgccacttcttgtggacttaaggcgctcggcagcaccatcgctgctgagggtctggaggtgtgcagaagagcttgcggtggccacggttactcccagttctctggtatcggcagcttctacgccgattacctcccaaccaccacctgggagggagacaactacatgttgacccagcaagtcgcacgctacctcctcaagattgcccgctccgtcctcaagggcaaggcacccgtcaacgacaccgccgagatcttccgcacctacttggacgcacaggacaagggctgcgccttcgacatcctctccaacgacggcgacatcgtcgcagccttcgcatggcgcacatcctacctcaccttcgaggccctcaagcaccgcgacggcgagaagaagtcgtggaactccctcctcgtcgacttctggcgcctgtccactgcccactcgcagtacctcgtcgtcaagaacttctacgacgccctgcagtcctcgtcgctcacctacgagctcgactccgtctccatcaccaccatgcaccagctcttccgcctcttcgccctcagcaccctcgagaaggaggccgccgagttctactcctcctccgccctcacagtccgccagatccagctcgtccgcacaaagtcggtcatgcagctcctcgccgacatcaggccgcacgccctgcgcctggttgacgcttggcagttcccggattggcagctcgacagcagtctgggccgcaaggatggtaaggtctacgaggatatgttccacagggccagccagctgaacccgctgaacggtctgaccgtggacccatacccagagagtgatgtgttgatcaagagcgatgagacgaaccgtgctttgcaggcgaagttgtag

SEQ ID NO: 188 - DNA, 1917 bp, Pseudogymnoascus pannorum
atgtccgaacctcagagcaatccctctatcgagttgaagagcgtggccccagacactttctcatcggattcggagagggggtttgagcacaatgcgcaattgaaaaacactaccgtcaagcatttcatttggcaagatgtcacggtcacagtgcaggaccgggccacaaagcagtccaaggcaatcttagagaatctgaatggagttgtctcagctggcgagatgtgtgctttgatgggcccgagtggttctggaaagacaactctgttgaacttcctcgccagacgcgacaaccctggagctgatgccaccggctttgcatctgtaaatggaaacgccatatccctcaatgagttcaggaaaatgagctcctacgtggaacaagaggatgccttgattgggtctttgacggtcagagagactatgaactttgctgcacgcttgtcaaactctggcctcacaaagaaggatcgtatcatgagaatcgatggcttgattgattcgtttggtcttcggaaacaggaacacactatcattggcacgccaattcgtcaggggattagcggtgggcagaaacgccgtgtcagtgtagcaagccagttgattacggcgccaaagatcttattcctggatgaaccaacaagcggcctcgactctgcggctagcttcgaagttgtttctttcattaagaccttggccaagcaaaacaatttgatcgtaattgctagcatacaccagccgtccacgcagacgttctcactattcgataagctgctcctcctgtcagagggtaaaccgcactattttggagctgtggacgatgtggttccatactatctggagatcgactacccggtgccattgcatatgaaccccgccgaacatgcattagaattgaccaacaaggattttggatcgggcctggtcgaggcagaagaagatttatccaagctccagtcagcctggtcttctaatccacgtgccaaagcgattgccagccagatcaactcctatctcatcactgccagcgagggccaaacacataattcgaagaccggctctcatgcaaactttgccgcggtcacattgaccctcgttcatcgctcttttatcaagtcgtaccgcgatgtcgtggcatacggaattcgcctagcaatgtacagctgtcttgctatcatgagcgggacggtttggctacgcctaagcccttcccagacgtccattcaacctttcatcaacgccatatttttcggagcttcgtttttatcgttcatggctgtcgcatacgtgccgtcattcctcgaagacaggttaacttttatcaaagagcgctcaaacggcctctatggtgccgctgccttcacagttgccaatttcatcattggactcccatatctgtttggcattgcactcatatttacgtgcatctcgtactggctgaccggcttccataataccgcccctgctttcttcacattcgtcatgtgggtattccttgacatggtagccgcagagagcttggtagtcctaatgtcctcgatctttcccaacttcgtcgtcgccctcgctctcacagctttcgtgaacggtctgtggatgtgcgttggcggcttcctgatttccacgcctctcttgaacgtgttctggaaatacgtgttccactacatcgattaccaagcctatgtcttccaaggattgatggtcaacgagtttgccgaccgcacgtacaactgtgaccaggactgtcactgcatgtacaccacggaactggcctcacaatgcatgatctctggaaagggagtcttggacacgtttgggatgtccaccggcctgacaggcacgtgggttgggatcttaattggaattgtagcagtgtatagacttcttggatgggctgtgttggcactcaagcgttaa

SEQ ID NO: 189 - DNA, 6342 bp, Pseudogymnoascus pannorum
atgcagccgcaaacagaaattatggcttcttgccaagtcctactttttggtgacttggccattcgtttcgaagatgagcttcgccagttagttcatgtcagggggaatgagagtctccgttcatttttcgatcaagtttgccatgcacttcgacaggagtttggggatcttcctggcagccagcaggaccttttccctcgatttactacgcttgtcgatcttgtctccaagctcgcagagacagagggcacccccgctttgagatttacccttcttccagtttgtgaaatcggccaatttattagatactatggggaagggtcaaggccgtatcctagtgccatcgacagctactgcttggggctctgtgcaggtgggtttgccgccgcagcagtcagtacatcccagactttggccgagttgatcccagcaggagtcgaagcagttctggcggcgtttcgaacggctctctgctctttagaagttcgtaataatatagaaggaccgagccttgagagacatcgatcttggtctgctgtggtcaatgctccggaaaaagaagcttctgaattaatccagcggtttattttggataagggtctcccacacagctgtaggccctatttgagcgcaataacaccgtcgaatgtaactatcagcggccctcccggcgtcttaaaagagttctttgcagaaagttcactaaagttttaccacatacctgtcgaattaccataccatgcccctcatcttttcgagccacgcgacgtcgacgaaatcatctgccgattcgatgacaaattatttggttcgtacaaaccacgaattcctatttggtccgcagcatctggaaaccccattgcagccgaaaattttaagactctgttgcataaagttgtgacggacacattacgtgaaccagtacagtggacgagtatcctcgaatcaagcgccaaacacctcggacataggaattttcaagaatgcacaataaacgctctatcatccaatgcctcctctctcctctcttcggccatatctcggagcaccaaaattcttgtcgccgttaatgacttggcttcgaaatctggatcagtaccacagcctcggagacacagtggccgtttagaccaatccaagattgctatagtcggttattccggtcgttttccagactctgcgtcaaatgaagaattttgggaattgctgcgcgccgggaaggatgttcatcgccttgtccctgaggatcgttttgactgggaagcacactttgaccccactggaaaggccaaaaacaccagccgggttaaatatgggtgcttcatcaaggaaccagggctatttgatgctcgcttttttaacatatccccaagagaagccgaaaacacagacccagctcaaagattggccattacaactacctatgaggcgcttgagatggcaggaatggtgcccaatagaacgccatcgacacaacaggaccgcatcggtgtcttctatggtgttactagcgacgactggagagaagttaatagtggccaaaatgtcgatacctattttattcctggtggcaaccgtgcatttgttccaggtaggattagttacttttttagattctcgggccccagtctcagcatagacaccgcctgttcctccagctttgctgctattcaaattgcttgcagtaatctgtggagaggcgagtgtgacactgccattgcaggtggaactaacgtcctgacgaaccccgacaattttgccggcctagatcgaggccattttctgacaactacaggcaattgcaatgcttttgacgatgaagctagcgggtattgtcgcgctgacgctgtgggatccgtcattctgaagagactggaggatgcccaagctgataacgaccctattttcggtgttattgccggggcatacacgaatcattgtggccaaacggattccataactagacctcatgaaggcgaccaaatatcagttttcaagcgaatcattcgacacgcaaacgtgaacccgctagatattagctacgtcgaaatgcacggaacaggaacacaagcgggagatgcgacggaaatgaattccgttttatcagtcttcgtccctgaacgtgaacgaatgccagattatccgctctacctaggctcagccaaagccaatatcggccatgcagaatcagcatccggagtctcttcccttatcaaggtcttaatgatgatgaaacacaatgaaatacccccccattgcggaataaaaacacggattaaccacaattatccactcgaccttacagagcgaaatgttaatattgctgccacacccatcccttggcatcgcacagcgtcagggaagcgctctgttttcttgaacaatttcagcgccgcagggggcaacacagccgtactcttggaagatgccccttttgcaccacattcaaacgatattagaagtgactctcgcagcagccatctcgttgctgttactggcaagtcggcaaagtcactaaacaacaacatcaaggttcttattgactttcttcagctgaatcccgaaactccgctgcctgcactgtcttacacgacgactgcgaggcggatgcactattcgtacaggacaatatgttcaggatcagacatcaaatttatcatagatgcattgaaaaaagctgcagattcggactcgaagccatctccaagcaccaaagttccaaaaatagcattcgctttctctggccaaggcagcctctattcaggcattggaaggcaattattcgagtctcaccctagctttaaagcggatatacttcgctttgatagcatagcgcagcaacaaggattcccaggctttttgcctttagttgacggtactgcttcggatgtagatggtgttgaaactgtcgcagctcaccttgccctcagctgcgtgcaaatggcgatctgtcgcctttggatttcttggggagttcgtccaaatttaacaattggacatagtcttggagaatatgccgcactacaagttgcaggtgttctcacacccagcgacgtcatatatcttgtcgggaccagggcccagttgctggcaagatattgcaaccaaggaacccacgccatgctgtccataaaggcatcgtcggatgatttaaaaacctatctgtcaggatcaacctgtgaaatagcttgtatgaaccagcctacaaataatgtaataagcggaccgaacgaggaggtaaaccgtctaatgcttttgtttcaatcgaagggttatgaatgcattaagcttggaatcccctttgcctttcattcagcccaagtggatcccattctagaggaatttgagtctgctgcaagcagcatctgttatcatgccccgacgttaccgtacatatctcctttactcggattggtcgtctcaggcgaaggagaactgaacgcatcgtatctgactcgggcatgtcgaagagcagtaaactttcaaggctccctaaagtcagctgaagcggcctctgctattgacagtcatactatctggattgaaattggatcacaccctgcatgctctggtatggtcaaaggaacaatcggtccacagtcgacgacaattccatcattaagaaagggcgttgatacgtggaaagtccttactgcaggtctcgaaacgctatacctcagtcgcgttaacatagagtggaatgagtggcatcgacattttaagagctcacacaaagttctccaactcccaagatacagctgggacttgaagaattactggatccagtaccgaaataacttctgtcttaccaaaggagaaggcacatcagccaatgctgcgcttccggtcgacacgaagcccagctatgcttccctgtcgccagctgtccaacgtgttctggaagagcaccatgctgcagacgtttccaacatcctcgtagagtcagacattcaagatccgcacctggcgcctgtgcttcaaggccataaggttaacggcgcttccctctgcccctcgtctctttacgcggatattgctctgacacttgccaactacatgatgaaggccgtcaatatgcaaggtagcgagataggccttgatgttgctgacatgaaagtcgacaagcctctcatagcacttgcggccggtgatccacagctgtttcgagtttctgcgtcagctaattgggcatcaaaaactatttcactagcattctacagcatcaatggccagggtgctaaaaaggcggaccatgctaaatgccttgtcaaactcgcctcgaaccaaacttggcttcaggattggaagcgcaatgcatatctgatcaagagcaggattgctgctctacacaaaggtgtcgatgaaggcgaatcacacaaactgaagcgcggacttgtctacaagctatttggggcaatagtagactatgatccgcaataccaaggcattcaggaagtaattttagacagtaatgagcttgaagctacggcaaaggttactttccaggtcggcgacggaggctattgtttcagtcctcattgggtagacagccttggacatattgctgggtttatcatgaatggcaacgacaatgttgagtccaaaagccaagttttcatcaatcatggttggagcgcaatgcgctgtgcaacgactttcgcatatggcaaaacttaccagacgtacaataagatgcaacttgtagaaggcacattgtatgcaggggacacatatattcttgaagaaggaaatatcgttgctattttcgaaggcgtcaagtttcaagggattccaaggagagttctagaccaggttttgccctcgaagcccagcacagtcaagaatgcagcgccgcctcaaaggccggtggcgaccactacctctgtctcagcggcaaggcaatcgccaaagtttccaacagcacctgatgtaactcttgtcaggccgccatcaaatgatatcatctctcaagtcatggcaatagtctcggatgaggcccacattgacccatcagagctcaagcccgagaccgagtttgcagattttggcatcgactcccttctctctctgacaatattgggcagattacgggacgaggctggacttgacctgccatctatgcttttttcagactatccaactgtcgagaagctccgaaatttcattggtgtggaccaaagcccgtctctgtcatccgggtcgtcgagtcaagatgatacagaggtgttgacatcagaagtagcgtctgagccagatacctataggcttgctgatatcatccgcaatactatctcagaggagactggggtccccattgaagagctcaccgtctcagccaggctctcggaacttggtatagactctcttcttgcattgacaaccatgggcaagctcagtgaagcccttgatatcgaggttccacagttgcttttcgtcgagaacgacacattgcatgatcttgaaagggccttggatatgacagtaaagcacacacatgtcaaaatgtgccccaatgtcgccagacttcaggccattgagcaagtcaacgtcgactcacctccatacgcaacctcggtcttacttcagggaaattcgaaaaccgcaacaaaaaagatctttctgttccccgacggttccgggtctgctacttcatacagctcccttgctcgcgtctctcctgatgtcgctgtatacggactaaactgcccgtggatgaagacaccagaagatatgaaggtcacgctcgaacaattgactgccaagtacctccttgaaatccgacgccgacagcctcatggcccctattactttggtggctggtctgccggcggcatatgcgcctacgaagcagcacagcagttgtctcgcgatggcgaggagaccgcgcgcctcatactcatcgactcgccgaacccagtaggcttggaaaaccctcctcagcgcatgtacgacttctttgatactctcgggatctttggggaaggtggcaagccgccgccaagctggcttcggccgcacttcgacgcgtttattcgactgctggacgactacaaggttgaagcttttgcgagcaagtcgatggaaacgcatatggtgtacgccagagatggcatctgcaaactgcctactgaccccaggcctgagattcgtcctgatgacccaagagagatgctgtggttattgaataaccggactgacttcagtggtagtggatggtgtgagctcgtaggaaaggacaatatgaagatcacggttttggataatgtgaatcacttcaccatggtggaaccgggaccagagatttccaagcttagcaattttatcagaaaggctatggagtga

SEQ ID NO: 190 - DNA, 1482 bp, Pseudogymnoascus pannorum
atgaccgaaccatcgcccccggagaaaagttcgccacagtcgccttctactgctgcgcatgttactccaaatgcttcaagtgaaggcgcgattgtcgacttcgatggcgctggtgatccagcgaacccgttgaactggtcgttttcaagaaaagtggttacgagtggtctctacagtctgacaagccttggatctgtgtgggcaagcacagcatactcccctgccaatagcaaggtcgccgatgagtttcatgtgtcaccagaagtagctatcatcgggacgagccttttactcttgggctggggatttggaccgttactctgggcgccgctgtcagaagtttacggccggaaatggccagttttgatcccattcttcatctctattgtgatgtcatttgggacggcgacggcaaaggatatccaaacgattctgattactcggttcttcaccggattctttggggctgctcctatcacctgcacaggaggagtctatgttgacatctgggatgcatcccaacggggaaatgctattgttgggtacacgctcgccgtgtgtggaggtccggctcttggacccgtcattggaggcgctattatttacagcggcacaaattggagatggactgaatatactacaggcatattgcaagcctcgatacttattccaggagtaatattcatcgaagaatcatacgtaccaatgttactcgtcagaaaggcacgcaagctgagacagaacacgggaaactgggcactgcacgccgagtgggaagaaaccggtgtttccatcaaggcactcgccataaagttcggcctacgacctcttcagatgctattgacgccaatttgcctctcggttaccatctactcatcatttatatacggcacattttatgccagcctggcatcgttccccatcatcttccaagaaacgcgaggctggaacgagctcgtcgggtcgcttccgttcctcggagtgcttataggaatcattatgggcgcagcactcagcgctctgaaccagaaatactacaacatcgcgtacgaagctaacgacttcaaaccggttccggagtctcgcctcccgccaatgatgattgcttcagtcgttttatcgggcggattgttcatcatgggatggacttcttcccccgacctcccgtggatagcaactttaataggagtcactatgatggggtttggatactatacgatttttaccagcgccttgaattatctcgtcgatacattccagcggtggggggccagtgctatagccgcaaatacgttcatgcgaagtgtgctcgcggctgcattcccgcttattgtcccgccaatgttccgacgtctcggaaatgaatgggcattaagtgtgctcgccatcttctcggtgtttaatatcccgattccgttcgtcttttggttttatgggcctcggatcagagcgatgggcaaatacagctcgaatatggggtag

SEQ ID NO: 191 - DNA, 1422 bp, Pseudogymnoascus pannorum
atgcggccccggctcccattcgacgatgttgcttgggaacaaagtgacaacgtttacgaagaatggcgaactaagcttctcaaaccagaaaatctaacggaaatcgctctttttgttgcaaagtatcaccttgggacgccagtgaaggttagaacgcctcttacgggcgcctataatgtggcggtggttgttgattttcgcggaggtggttcgacattgattcgctttcccaaaccaggtaggctgatgtttcccgaggagaaggtcaggaatgaagtcgccgtaatgcggtatattcaagctcatacgtcgatcccggtgccgtttatattgcactggggcacgaaggaacagagtccttgtggtctagggccgtttattattatggaatatgtcaatcatgactgtgatatcagtgacgcgttgaatacgccgggaataccatctgaggaccgaccaattcttgatcctgctgtagatgaaggaagactccggaaattatatgggcaaatggcagatgttctgcttcaactatccatgttgtcattccctaaaatagggtctctcactcaagacgacgatgaagatactttgactgtggccgcgagaccattgacggcaaatatgaacgaggtcgtacagctcgggacattgccacgttcaaagctacctgataaaagtgcagcctttgaggcttcttcgtcatacctgactacactagccaatatgcaccttcgccacttaacctaccagcgaaacgacgcgattgtcagcgcgagcgactgctgccaaaaatatatcgcaagatacctcttccgaaagctttccgttgaaggcaagctgtcacgtcctgagcacaatttcgggccttttaaactctggtgcgatgatctgcgcccagctaatatgctaattaattccaacctcgagttggtttccattattgacagggaatttgcatatgctgctcccgtggagttctcacatgcgcccccttggtggctcctaatagaacagccagagcactggtcggaaggactttacgcatgggctactgcttatgaacctcggcttcaaactttcttggccgttcttcgcgagcgtgaagatgtcctcatagacgagggaagacttaaagaccaggagagactctcgttgcctatgcgggagagctgggacagtggtgatttctgggtcgtatatgctgctcgcaagggctttgcatttgatgcggtattctggaagtatctggatgcacgcttctttggggctgtggatggagtggaaggggatgagtgggaaaggagagccgagttgctggacaaggaggaacttatggaaattgacagctttgtcgatcaaaaagtggttgaaatgaaaacccgagccttagcatgggaacccgaagaacatcttggataa

SEQ ID NO: 192 - DNA, 1359 bp, Verruconis gallopava
atggaggattcctttatcctgaagaacgtttcaatatttacaggtgatgactggatagattctggttgcatagcagttaggaatggcataatcaactacgtgggccgcggggatcctccagctcgaatagtacccgagggcactgcagttctctcattgccgcggagaagtgtgattcctggtctcatcgattcacgagttcattgtcaggaaggtaacattgaatgtctcgagcagtcgctgagattcggcgtgacgactgtctgcgacatgtatggcgaccctcagtatcttaatcttctaacacagcaagcacaagaccctgtgaacaaagacaagtatgccgactttaaatgtgcaggcatcgcagctagtatcgagagcgagtggcctggaacggagcttcaattatcccctgagaacaaacctgtaagcctagagttcagagcagagagtttaaaagcagtcactcaccaagaaatgaccgcatggcagtctagtgtcccggaggatatcttgcccaaactgaaatctgctgaggatgcagagcattacgtccgagaacaagtcgtcaaattcaacgcatcatatatcaaaatcatgcacgggatcggcgacgatgtcgacgtggaatttacggagccaagatgcgaagtgcaaaacgcagtggtagatgcggcgcacaggcgtggtttgatcgttttaggacatgcgttgagctattccgcggcgatggatctgctctcaaacggtgttgatgggttgaccaacatcttcattgatagatcgacatctcgcgactggattgagcttctaaagcgcaacaagggacacttgtgcccaactttgtcgttttatatctttcgcactctccaaggcgacgatattgaagagctgttcgcaagcgatccgttctcagagcgtttgctcttcgacaaaagttctcagaggaacgtcagtctcggttccaagcctgaagatgcagctttcgccaacgctgtgcgcaatgtacaagaggcatacaaagccggggtgccatttgtcatcggatcggccagcacaggcagagagattggcccggcatatgggttgggtgtccatatcgagatgtatctgctttcaaaagcagttggaatgactccaatggaggtcttgaagagtgcaacaagtgaagtcgcggatcgttttggattccatgatcgtggccgtgttgcagtaggcaagaaggcggatctggttctggttgagggtgacgtccgagaagccattgcagatccaaactgccggtgtctcccagtctcatgcgtgtggagagaaggtgttagctcgataatttaccaaagactggctgggccatag

SEQ ID NO: 193 - DNA, 1683 bp, Verruconis gallopava
atgactactattccagagaaggcaactgttcttgtgattggaggcgggccgggaggttcttacgccgctacggcacttgcaagagagggcgttgatgtggttttgcttgaggcagacaaatttcctcgttaccacatcggcgagagcatgttggcgtccatgcgccattttcttcgcttcatcgatcttgactccacattcgacaatcatggtttcatcaaaaagcgcggggcagccttcaagctgaatgacaaacccgaaggctttaccgatttcattgctgcgggaggaccgggaaactatgcctggaatgtgattcgctcagaagcggactacctaatgtttcagcatgctggaaagagcggcgtaaagacattcgatcaagtagccgtcagatcattggaattcactccatgtgacctcgaactaccggatccgaaaacaccaagccctggcagagcggtcgcagcttgctggtctagcaaggttgacggtacatctggcaaaatcagtttcgattatttagttgatgcgagtggtcgtttcggcataacgagcacgaagtatcttaaaaaccgcaagttcaatcagggattgaagaacatcgccaactggtcgtattggaagaacgcgggaagatacgcggttggaacccagagagagggtcagcccttttttgaggccctaagtgatgcaagcggctggtgctggttgattccactccatgatggtactgcctctgtcggtattgttcagaatcaggatgcggccgctgccaagaaaaaagccatggattcgccatcacaacatgacttctacattgaaagcttaaagctagcgccgaggattcaggcactgcttgcccaaggagagatgacggctcctgttaaacaagcctctgactggtcgtatagtgcatcatgctacgcttcgcctaacgttcgaattgttggtgatgctgggtgctttatcgatccctatttctcctctggggtgcaccttgcgctttccggtgccatgtcggcagcttgcacaattcgtgctgtgcagcgtgaagaatgcgacgaaaaagctgcaatggactggcactcgaagaaggtggccgaaggctatacacgcttcctgctcgtcgtcctcagtgccatgagacagatccgcaagtcagatcaaccaatcctgagcgactgggacgaggaaggtttcgaccgcgcttttgcattcttccgtccaatcattcagggaaccgccgacgtcagtaacaagctgagccaagaagagttggccaagacgattgacttttgtctcaatgctttccaacatcacgacgccgatgcgagagacgctatgatcaaaaagctgcaggagcacgagcaggaagctagaatgcgtggagatgttcaagccaaggcagatattgatccagattcactcactccagaagaattgcaggtgttgaagactattcgcgctcgacaaatgctgagaaccgaagatgttatcaatatcgattccttcggaactgacgcaattgatgggttcgctccacgggtgaagcacggagagctgggacttatgaagggtaagaactccggcccagctgctcccaagatggatctctttgcaaaggcgaaagaggagcctgcaatgcagacgcaagtgggtactgcagtcacagcgcattga

SEQ ID NO: 194 - DNA, 1554 bp, Verruconis gallopava
atgggcaatcaaatctcagcattgatgtctgatagcattgtcttcagtcttttcttgcgaatatcatatctaggcctaattctgtcgataatctatgttttggcagctttgacctacaacgtttattttcacccactcaaaaactaccccggaccattgtcgtgggcagcgacgcgtattccctggtgctggtaccaatatcacggtgtcaattggcgcaaaattcttgagcttcacgcaagatatggacatgttgtgcgcattggtccgaacgagcttagttacacctcctctgaggcttggaggattatctatgggcatcgtgttatcgaaatgggaaaagatccggtgttctcgctgcacactccaactggcgttcagaacatcctagtagctgaccgtccgacgcatacaagacagcgacgactacttgctcatgcgttctcagaaaaggcgttgcgtgagcaggaagagatccttcaatcctatactgatcaattgatccgtggcttagaagcccgccggcaagatgctgtcgacattggtgcatggttcatgtttaccacgttcgatctgatagccgatctgtcatttggcgacaatgtgggctgcctcgaaaagggcgagtatgatccatacgtggcagcaacaccagcaatttccaaggagttgcagtactaccagatgctaaagtactggggcatcgcctgggctcgaaaatggtttatgccaacctctgttgctggagcccggatggccaatatgaagcgcgccatgagtacggtcaacaatcgcatcgaaaaaaatggttcagtggatcgaaaggattttttgcactacattcttgcagcgaatgatgaaaaggggatgtcacgacaagaaattgacgttaatgcgttctcgatcagcactgccggttccgaatcaacggccacagccctttcaggtgcaatattttacctcttgcaacacccggcttcttatgcgagcgccacgcgtgaagtccgctcagcgttccatgcacctgaggagatcaccatgagcgaagtcaagaagttgaagtacttgaaagcagttttacaagaaactctgcgcctgtacccacccgttgctgttactttgccccgtcgcgttccagttgaagaggacggagtattcattgcaggtcatcctgttccagccggaacaacagttggtgtcaactattatgctgcattccattcaccttacaactttcaccttgccgagaagtttgctcctgaacgatggcttccagagcactcagatcatgcgccctacgcaaatgacaatagagatgtagtccagccattcagttacggaccgcgcaattgtttagggaagaatctcgcgtgggccgagatgcagctaattcttgcaagggtgttatggcattatgatattacatggcccaaagacaagcttggaaggccagaagttgatgaaggctggcagttaaaccaaaaactgtacggcttctgggtcaaaccaccactaagggtttgcttgaagccggccgatggaatcaggaaatga

SEQ ID NO: 195 - DNA, 708 bp, Verruconis gallopava
atggacgcttaccatctggatcctccgaaagttgcatcagcgcaaacggcggcatctcctgaagagaaggccataccacagcccaggccgggacctactacgactcccccagttcttgatacggcaacactcaagtacatcaaaacactaagtatcaaacatttccgttctgcagatgtcccatggcgctccatgggtcagtacaagtaccgcattatcgaggatggcactcttacccaagaccgcatatccgtggtagagtcgcttatcccgccaaaatcacacggtcctatttttcatttccatgagatgcacgacgaatgcttctacgtcacacaaggcactgtgcgttttcattcgccaggaagcccgccagtggacgctcatgtgggggacatggtaacagtgccaacgaggatgcctcatcgattcagcaacccatttgatgaggaggccaaatttgtatcaacaaacacaccgagtcactatgcacgttacttctactacctggaatacctgattggtgagggaaatgagctgacaccagaagtgaataaagaagcaatgcgtcggttcgctacggtgccattatcgcccgcggacattgaattgttggaaagagaattgggcgccggcacagttggaaatgagaacgagtacaattcagacgagtcagtagatacggcggacttggtcagtcttgattag

SEQ ID NO: 196 - DNA, 1233 bp, Verruconis gallopava
atgcccgcctccaaattggcacaagagtctactcaaaagccagaattcaggccgaccgtttatggactgatttctgagctttgcgtgttgctgaataagctagagagtgatcgtgcggaggtgccctcccttgcagcgggcgcgcattccaagctgtggactgcccaaggcgatagcttagcggcgtctcgcgatcgagctttggagcttttgaggaacctatgccagctattgcaaggaccgcatgaatactttcattccttggtgtcttcaaattgggatcttggagctctctacacaatcatcgagcttggaatattggagaaaatccctttgacctcttgcgcaaacgtgattgatctttctgaagagcttggcttagatgagcggaaattgcttacactcctccgacttgtcacatgctcaaacattctttacgaggccgaagacgggttctttgggcatactgccctgtctcaagagcttttgcaagacgagcaattccgagccttcataggattccagctgtttgaggccaggatcggcagtgtgcatttggcagactccctgaaggggagcaaaaacacctttgagcatgggtgttcagctttcaaacacgcaatgggtataccgctataccagtggcatggtgagaacacggagaaaggtacgaggttccgtatggctatgcagggggtctcaaaaagtctagaccctggtgacgatttgttccgtcagtggtttaagcagcattctgaatctggcacatgtctaaccgtcgtcgacgttcttggaggcaacaaaccaagccagcaaaagttcattggcgagtttccagagctcaatttcgtttccgttcacgacattggcgaaatagcctttgttgacggacctattctggcatatgtcgtccgcaatgtgttctggaacaagagagacaacgaggtgatctccgtgattcggagcatccaccaagctatggagaaaaacgcaaaagccacgctgttgattaatgaaatgctgtcgccagctagaggcgaattcccaggagatctcgagcacgcctatcgtcgacgcgacgttacaacgatgactatgcacaacgcgaagcaacggactgtcgctgaatggcatgggctatttcgtgaagtagatctaaagtggaagatccgactggtcacgggtaattcgtcacatagctacagagggctttgggagatacaaatgaattag

SEQ ID NO: 197 - DNA, 2223 bp, Verruconis gallopava
atgataattctggggcttccgaccgcgcttgtgcactttgtcgggagaaaaaaatccgttgtggccgagagaaacccaaatgtggcaattgtaaacgtcagaaatggcgctgtgactactctgcgccagaaaagcgtaagtgaaaatgtcaactctatcgatgctcgattgggcaacattgagaacgaaatctttcgtcttataagatcccaaaacgcgcccaggtctcgacatggctcggagggcacgcctacatcgtatgagagtccgttcaatccaagtgacaccgaagatgagtcgcggggcagcctgttgacaacagaaagacaactcttgcactcgccagtcacggattcatactacggaccggatacgttttatgcatgggccactgccttcaaagggctagtgacatctcggcgacaaaaagtaggaaaggatgtctctcaacaagggctgaattttgcggttgatgatgagctgggctccatcgaccatgatttatcggaattagtacgatatgccgagagacaggacacgctgtacgactcgagaatcaccgaaacctcaatcatgttgccacccaagcagttcctgccgatgtttcatacaagattctttcaccacaacgattggtcaacagatctatttgttcaagaaaggttttggcagaacgttgatcgagtgtatgccaattacaactctactctagacgaaccatgggcaattgttttcaatacaattatactactttctatgagcgcagaaaactctctccagactcatgctcccttggcaacttcgcaatttgctgcccccttcttttcagcgctcaaagttgccctcaataaagtccatttattaatggcgccgcgactcataaacgtacaagccttggcccttctaagcttagctgccgagcaatttcatccgttcggagttgcagaagcagtgtttgtgcaagcctgtaatctggcaagacgaatgggtcttaatcagattgcgatgactggaacatcggatgcaattgaagaggaagagcgtctcaaagtctcaagggctttatacattcgtgacaaaagcctgggtatttcacgaggcaccatatgctggctgccagggtttgaagtgcaaaatatgaaactggacgactttgaatcagccgaaggaagataccatgctgcacgagtcacgattactgcttttcaggagcgcgtgtatcgcctccattcttcatctggggctcaagatgactttgctaacaaagcgggcttccatccctctggtatacaacacggtttggccgatcttctggaaattggcacgatgtgcggtccccaccttgaactttggttagaattcctcgctacccgtattgttgctctacgaaggaacactaaagcgcattacgtcaagcgcactttaaaagattgtagagcatgttgcatcctgctactattggcattcggaaagggtgacaaagcactgagggaacgactcgagcaccattgcgacctccatacaacttctcaacaaggttccaaatcatcctctctagactctgaaatcagcctcaatgagcacgcaatatcgacgccaagaactctcctctcactcttcccggtgtctagcttatttctgttggctgcaaacgtgatcaaccctgcaactccagaggaggaagcgaacactgatgatgactacgagcttctcgtcagagtttgcgattgctacgaggaagctgatgcaagcctacaagccatcaacagggcccatcaagttggtaaggcgctccaaagaattctgtccatcattcaacacgtgcgtgggatgaatggcacttcccctagcaaaagcacgagtggttcgggtagcagccgatgtcactccgcgtcgttgtcatccagtcagctggaacaaggcggttcttttccagatcagtcgagtttgcagcatctgccaagttctggtttcataaactcgcagcatttcacagatggggcgccgctatcttcactctgtgtgaacgatattgagacattcgtaatgaacacgccatcaggacatgagataagctcggcgttctccgtggaaaatgatatgatgagcttcatgaggcaagatgctatgacttcgaatcatttcagatcggacaattacggaatggaaatttgttatccagtggagggtgcggacccaaatggcgggttgccgggaatatga

SEQ ID NO: 198 - DNA, 1287 bp, Verruconis gallopava
atggcacattctcaggattttgaagttcttatcattggagccggcatcaccggcctcgtgcttgcacaagctctgaagaaggttggaataaagtacaaaatcttcgaacgagaggtacagatgaactatcggagcaacgagtggacgatggcaatccattggtctcttgagcgcctggaaaatctccttccaaaggagatctgggagaaactgcccacgatatcctgcaatccagctattcctatggatgctggaggcaagtatcccatcattcatggtgaaaccggcaagctcctggccggtgtgccatatgccaggggcttgcgtgtcccacgcagcaaaatgagagctctgtgtgctgaaggaatcgatgtgcagtacggcatgaagcttactggagtcgatttcgatgcctctggagttggcgtaacggctacctttaatgactatgagaaagtcaaagcgtccctcatcattggcactgacggcccaaggtctacgatgcgcatttttgccatgggaagcgaggcagaggcgtctactagcaaatttccaatctttcatacgaacatgacagtttgctacggcgacgctgaaaaggcaaagtatttgcgccaggaatttcccacgagttatctcgctctcagcgaaaatagctaccacgctttccagtcaatttccagtatgcctgatggacctgagcatcctgagacctgggtgttccatctggccatggcttggctcggggactctgatcagtccatgagctatcctgaaagactcgctttgatcaaaagcaaggctcagacccttggtgagcctgcaagatctgcctttacatggataccagagaacacgcttgttcacaaggcggacatcagttactggattagcaaaccgtggaataatcacgacggtagaatgaccttggctggcgatgcagcccacgccatgccaccttaccgcgggcaaggtctcaaccattgcatctgcgatgtgtctcaccttcttgaaaagatccaaagcatcttgaataatgagatgggtcaaaaggaagccatctctgcctatgatgacgaggtcgttaaaaggggtgctgaggaggtaaaatgctcgctggagaatgctctcatgctgcacgactgggagaaagtgcagagatcacctgtgtttacaaccggcttcaagccaatgactgggcatgacggggagaactctcatcaaagaatgcttcccgaagccttgaagactcttcaagaagtcaagcaacagattgctagtcattag

SEQ ID NO: 199 - DNA, 6375 bp, Verruconis gallopava
atgacaaaagctatgcgggtcttcctctttggagacctaaatgtctccttcgaggagagcctcagagagttgctctacaccaaggacatgccagtcttgaaatctttccttgaaaaggtggcttttgcgcttcgtgaggagatttcccgcatgtcctcttcctggcaggcgttaatgccacgttttactaccttaatcgatctgctccctcagatcaatggcaagataggaagtccggcgcttagatttgctttgctctgtgtggcggagctaggactgttcattcgcttccatgagcgaaggtctattccatatcctaccggggacaactcgtgtctcttgggtatctgcactggatcttttgctgcagctgcagtcgccgtatcccgtggccttacggacctcgttcccgctggcgtcgaggcgactcttgtagccctacgtacagccacactctcgctgcaatgtcgctttgacatgtgcaacatgacagagacaggctcatcctgctggtccgctattgtcaacctcacggaagaggacgctactaagcttgttgatgctttctgtgaagctcatccgcgagtcagtaggccctatctcagtgcggtgtccccaacaaatgtgaccatcagtgcgaatcctcaagttctcgacgacttcttggccttcgccaaagtgcaatttcgaaagctctccatcgagtctccataccatgcgccacagctatttccggaagttgtttgcctttctacggtcaaaaaatatcacgattctcagctcgaagcacgccagttgcatgttccgctcctgcttccttctggagcagaatgcgagtctcgaagcttcgaagatgtgttgaaggcgagcactcttcacacactccatgagaaagtacgatgggatcgtgttatcgaaactgtgtgcactttactgcagcagcgtaaggctagtgcgtgcgaaatcattcctgtgctgtccaatgcgccgcagctattgttcacgcacattcctcggaagtgtgacatccaaactgtcgtcagcgacctagagcgatgcgaccaaggatcggcttggagcaatccaaccggcaagtttgagcagtccaagatcgcgatcatcggcttttcgggtcggtatcctgactcttccagcaacgacgagttctgggagctgctacgtgctggacgcgatgtgcacaagagaatccccgaggataggttcgactgggaggcacacttcgatcccacgggaaagaagagaaataccagcagggtccagtacgggtgcttcatcaaagagcctggcgttttcgacactcgatttttcaacatgtctccacgcgaggctgctagtaccgatcctgcgcagcgcctgttgatcacgtctacgtatgaagcgcttgagatggcgggcttcgtgccgaatcgtacgccgtcaagccaggtggaccgcgttggggttttcatgggcacaacaagcgacgactggcgcgaggtcaacagcggacaagatgtcgacacgtacttcatcccgggggggaaccgcgccttcatccccggcagaatcagttatttcttcaagttctccgggccgagcctcagcatcgatacggcgtgctcttccagcttctccgccatccacgcagcctgcgcgtacttgtggaagggcgactgtgacacggcgatcgcgggcggcaccaacgtcctgaccaatccggacaacttcgccgggcttgaccgaggccactttctgtctacaacgggaaactgtaaaccgttcgacgacgctgcggatggctactgccgtgcagacgcggttggctgcgtcatcctcaagcgatacgaggacgccgtcgccgacaacgaccccgtctacggcctgatcgcaggagcgcacacaaatcattgcggccaggccgaatccatcacgcgtcctcacgagggcgatcaggcgtccgtgtttaatcgcgtcttgagatacaccaaccaagatcctcgggacgtcagctacgttgagatgcacggaacaggcacgcaagctggggatgccaccgagatgaactccgtcctgtcatgctttgtcagaggcaagcaacggacagcagagtatccgttgtacattggctctgcgaaggccaacattgggcacgcagaatctgcatctggcgtctcctcgctgatcaaggtgttgctaatgatgaagcacaacgaaatcccgccgcactgcggaatcaaggggaagatcaaccacaattacccagatctcaaggcgctgaatgtccacattgctttcaaaccaacaccgtggacacgcgagggctgcgtcggtggcaaacgtattgcatttttgaacaatttcagcgccgcaggcggcaatacggctcttttgctcgaagacggtcccgttcgcgcaaccccagcaaaagacatttcaaggtcaatttaccctgtggcagtttctgcgaagagtgcgaaatctctcgagcgtaatgtgaaagcaatgattgcatttcttgaggcgaatcctgacactgctctccctagcctctcatataccaccacagcgcgacgcattcatcacaacttcagaaccatggtttctggaacagacttaaagtcaataaagctcgagcttgacaagatcctgtcaagtcttccagagaagcccattcccaatgctgctttgctgccgaagattgcatttgcttttactggtcagggttccttgtacgtgggagtcacgaaggagcttttcgatgccgacgaagtgttcaggagcgaagtgctgcgcttggatatcattgctcaacagcatggactaccaagcttcattccactcctcgatggaagtgcatctgcgaggcaacttgaacaacctactatggcgcatgttggtcacacggcgctgcagattgccctaacgaacatgtggtctcggtttggaatttcacctgctctggtcatcggccatagccttggcgaatacgccgcactttatgctgcaggagtgctgacggcctctgatgcgatttatcttgttgggtcccgcgcgcgtctgcttgaacaatcctgtactcctcgctcgcatgccatgatttcagtcaaggcttccatggctgcagttgagccaatagtccaaagtgggtcatcctgcgagattgcatgtgtaaatcagcctgatgccaccgttttgagcggtccgcgggaagaaatagattgcattatgaaagagctcgaaacactggggcataaatgcatcaaacttgaaattccatatgccttccattcggcacaggttgacccgattctggagcctctgggactttgtgaaagagctgtacaattttcaaatccgaaaattcctttcctgtcaccaatgatggcagctgtaatcacagaggtggaacctttcaaggatgcatatctgactaaagcatgtcgtaaaccagtcaatttccatgctgctcttcaagctgcgcaggaattaggaatagtgggtgacaagactttatggcttgaaatcggacctcatcctttgtgcgcgggaatgatcaaagcgactcttggctctgactcagtcacaatgccaactctgacaaaacgccagacctctttggcctctgtggttgttgctttacaagatctctacatacgaggaattgctgttgactggaacgagtattatcgacaagacgctacttcgcttcaagttattgagcttccacagtacaagtgggatcttaagaactactggattcaatataaaaacaacttctgtctaactaagggcgacagcattgagacaaaggatctttcacgctgtaccgtaccgaccgtcgaaaaaacgattatcacgcctgctgttcaacacattattgaaatcagtaaggaaaaggcctccattgttactgagaccgacatcagccattctgcactttccaacgtgattcaaggccacaaggtcaatggaattgcattgtgtccgtcatctctctacgcagacatggccatgactgtttgtgaacagttgtgcaacgcctgcgagatacgcatcgaggaaagcagcttcgaggtcggtagtatgaacgtcaaaaagcctcttatcgcagatggatcaactcaattattgcgcgtatccgcaacagctgatttcgattcacgggaaattgatttgtctttttacagtgtttccgcgagtggtactaaattagctgaccacgcaacttgtaaagctcgtatcaggagcaagggctctcgcgatgactggcaaaggatgtctttcctgatcaaacacagactggaagctcttgaagccagtgttgatcatggcaccgcgaataagatgaaacggggtattgtttacaagctcttcagcgctttagtcgactacagtcaaggttatcgcggcatggaggaggtaactcttgacagcagtgcacttgaagctacggccaaggttcgcttccaatgtggccccgaaggctacgttctcaaccctcagtggatagattgtctgggccatatcgccggtttcatcatgaacggaaatgactctgttgcttccagagacacagtcttcgtgaatcatggttgggaaaatatgcagatcgcaactaagttctccgaggataagacatatcggacatataacaagatgcagctgaccaccaacaatatctatgttggggacacatacatccttgagggtgacgaaatagttgccatttattctggcataaagtttcaaggtgtgcctcgtcgtgtactcgaccagttgcttccgtctgggcagcggcgagcaattccagtcaccacaacacctgctcccaaacttcaagaagccaaaatttcaaatgctctttctaaggggaagagtatttcatcaccgaagcacaaggtgtcatctattaaagacacgattctcaatctaattgccgaggctgttggccttgatgtcaacgaactgaaacccgacacgacctttgacgagtgcggagttgattctttactctcactcaatatttctaaagcgatgcatgatcagcttgggctggatatcaactccagtacatttgcagaatgtccaacaatcagctctttcttgagccgggttaaagaaaacgaagcttctccagggactctaacacctcaatcatccaattccagtactaccgatctcgatagtcttctggatgacaatataagtctcgcgtcatctattactagcgatgaagacgagaaagaggagccacttgaaaagagcaccaacaagactatcgagctcatcagatcagttattgctgccgaagttggacttgaaccatctgaaattggtgattcgacaaatttctcagacctcggcattgactctttgctcagccttaacattatgagtcgtctagaggagattatcgagagcgagattccaaggatgctactcgcggaaaatgagacactcgagaaggtagctcgcgcacttggtctgcagacaaccgtatcgaatgtgactctggaaaaacaaaagcagaagctaagcaacaatacttccgaaacaaagtttgcagtaaggagtccaccgcatgcttctagccacctcctgcaaggtaacgcgaagactgcgacgaaaaagctttttctttttccagatggttctggctctgccttttcctacgcaagcctctcaaggatatccccctctgtggcggtctatggccttgcatgtccatggcagaaagatccatggtccatggccggcgtgtctttctctcagctcagcgccaaatttatcgcagctatcaaaaagatccaaccatgtggaccatatcacctcggtggctggtctgccggtggaatcagtgcgtacgatgctgcgcaacagcttgctgccgatggcgatgttgtagagagccttgtactgattgactctcccaatcccattggactcgagaaccctccacagcggatgtatgacttctttgacgaacttgactttttcggcatggaaggcaaagcaccaccaacatggctccgcgctcactttgatgccttccttacaacgcttgatgagtacaagattgctccatggaaacaaggaaacagcccagctacgtacattgtatacgcaaaaaatggcgtgtgcgacatgctgaagcctgaggatccgcgccccgagatcagggatgacgaccctagggaaatgaagtggctactgaacacgcggactgacttttctgcgacaggctggaagagccttgttggagattgcaatgtcagtgttggggttattgaaggagtcaaccatttcagcatgatgaataaggggcccaagtcggatgagcttgcagacttcatcaagagtgcattgaagatgtag

SEQ ID NO: 200 - DNA, 1449 bp, Moniliophthora roreri
atggcttctgactctgcagattttcgacatgacggcgaggacatctctgagcaagctcaattctccggctcctctagctccgaacatttgcctttagacgcgacgacatccatttcactcgcagcgagctcgaaaagcaaggagaagaaatcaagccagacacaggcagtacaagtcgaagcatttgaggtcgtcgacccggaaaaggatcagagaccagtcgaagcatcatctcctccacccgatggtgggcttcgagcgtggctcgtggtactgggttcttcgttggtgtctctagcaacttttgggattgttaacgcgtatggtgccttctcagacgagtatcaacacactcgcctctccaactattccccaacgctcgtatcgatgattggatcaatacaagtctttctactgtacttcttgggcgccttctctggttccatcttcgatgctgtgggacctcgatacatgattccagccagcgggttgatctgcagttttgccatgttcatgctgtcaatcacaaagcctcagcaaatctaccaggtttacttgacacagagcattcttttcaacatcggcggtgcattcgggttctttccgtccgtgagtgtcatcgcgcagtggttcaagttcaggctggcctatgctatgggctttgtcattgcctccgcgggtctcggcggcatcatctttccgagcatgattcggcaattagtcccaaagattgggtttggatggacagtgcgcataatcgccttcatagttctcttctgtttcacggttgcaacccttaccatccgttcgcgacgtcctaccaagcctcttcctcctttcaagtctattctggcattcaccgcgtggcgtgatcgacgtttcgtagtctttgctatcggtgcattcttcaacatcttcagcatgttccccgtcttcttctcaattggcgcttatgggattgctacggacaacaccgaaggcgcatacctattgatcatcctctctgctactaccattgtgggcagagtgcttccaaatttcttggccgacaaaattggaagattcaatacgatcgccttctcgactacagttgcagctatattctctctctccctctggttcacggcggacggtaaagaggggaacacgatcgccttcgctgcagtgtacggcttcttttcgggaccactcttctctttaatgccgccatgcattgcgtacattacacctgtcgatcgtgtgggcggtcgaattggaatgctcttcgcattcttgtctttcgccgggctcgcaggatcacctcttggtggcttgttcctgaacggaggagagaccgttccacacttcaagaatctcattctttatacgggttgtgttggtctctttggctcggcgatgttaatcgccgcaagattcactatcaaccgcaagttatgggctgcagtttga

SEQ ID NO: 201 - DNA, 921 bp, Moniliophthora roreri
atgcgtgttcttgttcttggtgctactggtgtcattggtggacccattgctcaggcatttgtccgggctggccattatgtcgttggtctaacgcgttcagaagccaaggccaaacagcttgctgctgatgaaatcgttcctattattggcgagcccactgagccagagaaatggatcgatgtcattcgtgacctcgacgtcgttgttgaagctgttggtggtaccgctgaaatttggacactcgccaagaagctcctggaaaccatctccaaagctgccgctgaacttcgcccacctcatgctcccaaactgacctacatctacacttccggcacctgggtacatggtgaagaccgtgaaaccctcagtgtctccgacaccacacctctcttcaaatctgccgaactcgtctcctggcgtccagctgtcgagcagctcattatcaaggatcagggtgtgaacggcatcgttatccgcccagctcttctctacggcagatcagcctctctcctggcacctctcttccaatcagcatcagaaggcaagatcgtctggcctgggactcctgggggccgatatgctctgattcacatggacgatctcgccgatctctaccttagagctgctgagagggcgcctcttgtcggtggacagatcttcgatgccgccaatgacttcaccgagtcacaggcagatatcttgttcgctctggctaaggtatctggtgctaagagtcacgagttctcgccccctgccaacaactgggaacttgcactctcccaaaccactaatcttcgaccatacctagctcgcagccttctaggctggcagccgaagaaagctggtcttgtcgaccatctgcccatttactacgctgcttggcaggctggcgcaggtgctcctcaacgcccacagcactga

SEQ ID NO: 202 - DNA, 3261 bp, Moniliophthora roreri
atgattctctatcaattatctcctatcgctatggggaagttcatccgaccgtatcttaacttgggctatgaggcagaccgcccagatggcatcaacggtcttcctgagctcatagcttttaacgcgaaccataatcccgacctagtctttggtcgtcagacgcgcactgatggatccttctgcgaaatcacatttgtccaactccacgaagccgtagagcgatgctcagcctggctcgtctcttctggagcaactaccgtccgcaagccaggagataccttccccaaacccgttggtatcctccttggtagcgacatcaccatattcatcttcatggccgctcttctccgtattggaacacctgtgctgtgcctttcggccagactcacttcagtagctgttgctcatcttctcaaagctacttcagcctctactattctctacagttctcaagtatctcgcaccattcgagatttgcaggctgactctgagaatgagttggctgtcaagttccaacttgcgcttgggtatgaagcatttatggacccccaacatcccgagctttccactgcctctgcacctgagccgtatgtatacaccgttcagcatgaactcggtgcagtcatcatgcatagctctggaacgactggccttccaaagcccatatatcatgcgccggcgtatattctagggtatgcggcttgccacgaactcgctgaaccttctgatcgctatgggtacaacgtctcaacacttcctttataccatggattcggactcctcgcaccaacgctggctttatccatcggattatcgttcgtattacctcccgcatctacaatccccactgcacggactacccttgctgctctcaaggtcaacgaggctcagtcaatgctttccgtgccttccatacttgaagacattttgaacagttcggatcctgatgccattgctattctcaaatcacttaacttcatcgctattggtggagcccctatgaaggagtccgtggcggagcaactagtggcacaaggcgtcaagctcctaaaccattggggtgctacagagattggtgccattgcgcccgtccgatgcccacccccagattacgactggcattatcttatcccgcgcaaggatcttgggcttgaagtcgttcctctcgacccatccgaccctaacacttccttccgtctcatcggtcacccacaaggctggcctggtccataccacgtacaagatcttcttgtgcgtaaccctaatgcaccctcgcagcttcgtatcctgggtcgagcagacgacctgctagtcctcgcaaccggtgaaaaggttcgtcctactgggatggaacgggctgtttctgagcacccttctgtcaaggatgcattagtatttggtgtcggccagcctgctcttgggttgctcatcgaactgcacaacagcgtcgaagagagcgaggagcacgtattggacagtctgatgccatatttggagaaaggaaacgcattgacagatgctcatggcaaggtcactccgaacatgatcatcttcaccaaggcttctgtaaagccgctcaaccgtaccgataagggtagtttggcgcgcaaagagacctacgcagccttcgacaaggagatcaaggcatgctacgagcgtgcagagcaagcagaggctgagccattccctacgggtgacgaagcagtcttacgcagcgccattaggaaactcgtcgtaacctgcgctactacagctgctgtggatttctctgatggatcgaagaacgattccttcgatttctttgaagttggaatggatagtttgcaggccacccgcctgagaagagcaattcagagcgcgttactggccactccgattgcatcgaagccagttctaccttccgacttctgtttccaaaactcgtctatcagcaagttgactcgtgcagtttctgacatattgtcgggtattagcctagatgatggtctcgacaaggagacgagacgggtggctgcgatgaatgagatggtctccaagtataccgaagagctcaaaacctacgcggcactcgcgcagagtaccaggaaagcaccatggagggaagttacaggcaaggttgtcttgatcactggttctactggaagcttgggttgtatgttgttggagaagttgtcaggggacccaactgtgcagaaactgttctgcttgaacagacctcgcgcaggtggtgctgaggcggcgagagcatatcaaatgagttctatcaagaagcgaggtgccgtcgtgaaggacgaaaattggtcgaagattgtttttctcgaggcgtcaactggtgcggagaacttgggactcgatggtatccaatatcaacagctcctcgatgtgacacatatcattcacaacgcctggcccgtcgacttcaaccgaaacctttcatcgttcgaaccgcatgtcaaggcagtgtccaacttggtgaaactctgcttgcagtcctctgttggcagacctaagcggatactctttgcatcatccatcgctgtcgtgggcaactaccccactttgaacgccgatgacgactactgctgggacgtcccagaacaagccatcgatgcacgcaccactgatgactttggttaccccgaagcgaaatgggtatgtgaaatggtattggatgcggctaacgcgctgtatggaacgggtgaagagcctctagtccgtggctcttctgtgcgcattggtcaaatgactggcccagaaggcataggtgcctggaacgagagtgaacattttccaatcatctgcaagacggcccagcttgtcaaagcactgcctgccttgagtggatcactatcatggatgcctgtcaatcgcgctgcttcggtgatttgtgaactccttttctcccggcatttccgatcattctatcatatggagaaccctgccaggcaatcctggtcaggtattctcgagaacctgtccaccattcttgctggccctcgtcagcaaccacttccactcattccgttcgccgaatggattgaacgagtgcaagccctcggtaatgacccgtcggtaaacactgcggcgaaaattatgcagtttattcagcatgatttcgttcgaatggctgccggtacagtcatcttgaataccaaatatgccaaggaagattccccgacgatggtgagaagtacctcagttgatcggaagcatctagaagagtactgcacgtactggcgaagcgtcaactctttgatttag

SEQ ID NO: 203 - DNA, 876 bp, Moniliophthora roreri
atgacttctccgctggttatcattgttactggtgccaataaaggcattggttttgaaactattcgcaatcttgcaaagaatgcatcctcttcattcctcgccaaggaagtcaaagccgacggtgctctcatctatttgacggctcgtgacgaagctcgaggcaaagaagctctgcagaaactcaggctcagtggatctactcgcattgagttcgtgcaactcgatgtgagcgatcctcagtcggttgaacaattcaagaacttcattgcttcaaggcatgaacgtgttcatgctctcatcaataatgccggggtagcccctgctgttgctggtgacggtgggcggttcgacagtaaaacaatcaactgggtgatgagcgtcaattactggggtgttcgctctatgacaaaggcgttcttacctcttatgcacgagaaagggcgaatcgtgaacctctcgagtggtttgagccatcttggccctatcagcaaccggaccctggtacagcgtttcctcaccgcatcgagggtggagcaagctgacgcactagctaaggagtggcaggattcagttgctgatggttcttacagcaagaaaggctggccatcgatgtcttacagtgtgtccaagatgctcatgaatgctttgactcgggcgttcgcagctgagaatgctaaagcacaccctaatctcttgatcaactggattgaacccggctgggtgacgacagacatgggaggtccatgggcgagcgacggagacgcaaaagaaggttcacgatgtcctacattcgctgcaataggtgaccttaagggaaagtcgggggtcggcttcgataaagacacgaatgaaagggagtggtactccaggaaatag

SEQ ID NO: 204 - DNA, 2076 bp, Moniliophthora roreri
atgggcgacattcgcggtctagaagaacatcagttcgagcagtacgatgtagttgtcgttggcgcaggtcccgctggtatgatgacagcaaccggcctcgcaagaatgggtatcaaacccctcgttatcgactctactgatcacgctggacacgaatacggccgctcagacgctttccaaagccgatgcatggaagtcatgcaaagtttcggggcgcctatcgagcaacttgaacacatgggaaagaagctttacggacgcacattctgggaaatcaccaacgaaaataatgttgccagaacagcatatgcgcgattctatcccgaatttcttgattacgataaagactactctcttgctgtgcgccaggggctcatcgaacaggtcttggcgcatgacatcgagcgccattacaaaggcttcaaagtccagtggaatacacagttcgtttcgatggaactgcctaagactggcgaagaggacggcttctctacgtcggttgttataaaggatttgaagaccgggatagagaagacggtcgtatgcaagtatgttgttgcctgtgatggtgcgcgctccaccgttcgtcgatgggcatcccaattcggtgtgaaactggaaggtgctacccttccagtaacgtggtgtgttttagacgctgtcggactacgaagtgatcacccagaccttgagaagctttgcgttgttcgctcgactaaaggcattgtacttgtcattcccagagagccgattaatggtaaacctgcagcacggttcgacattcaaatcaacaagggtcgagaagatacaacttgtgaggacgcgacagagatgataaaggccattttccatcctttcaaagtggagtgggacgaagttaactggtggtctatctatgatgtggggcaaaggataattaatcgttatagtattcagaacaaggtgtttttcgtaggcgacacctgccatacccacagccctcgcgctggaatgggcctcaataccgctttattggagggtcacaaccttgcttggaaactcgctctggtactgaagggcgtcattcgtccctccctcctctctacgtatgcttctgagcgacatgcggttgccaaacagctcgtcagcatggatcgtcaattggtcggactgtacgcaggtttggaggaacagactgtcacggacttttcctctgatgcaaccacacattggcttgaaaaattgcgaacattccaggctgaaaactatgcattccaagccggcgcttctgtggtctatggcgtcaacgagctcaccgttacacctactggggagtccgacaaaatgaccattgggaagcccggcgttgccgtcggctcgcgtaccagacctgccgttgtaacgcgtctttccgatggtgttccagtaccaatccttcctcgtttcgacggtaaattctctatctatatcctcgtcggtcctctggatgctcctggcgtgctcaacaacctcaaggccatcgataattatattcgaacatccggagggtccatctttacgaaatacggctccgatgtagacgttcacgcgaaagctgtcagtgacagaatgcctacactccgcatccccaacggtacggattcctacgaccctaacttcccagaaggccggcttctgtacacatacgactacgaggatattcctcagatttgtggtgaatacttagcaccaccccacacccttttccgcgtctcagtcgtcactaccacttccgtgcactcccctttgatccagggccccatcctcgatatgctctacccatgtgagtctgacaaggcacaggctaaacattcacgtatccttcaccctgcctggttcttctccgacgatatccccattgtctccccttaccgagagactgctcccgaggcgggaacactcttcgagaatcccatgcaccagaaatgggctatcgacccgaccattggttccatcgtagttgcgcgccccgacgcacatgttggaacgaagacagttggttttaatgtagaggcatggaagcaagtagaatcttacttccaaggattcctgttatag

SEQ ID NO: 205 - DNA, 6606 bp, Moniliophthora roreri
atggcacctacgaccacattcatcaatgttcctgtcttcgccggtcacggtacgactgccatggctgcgtcttccactcgtgaacaggccattgctgatgcttctcacccatctggcgctttgcttctcagctcgttccatcgtgctttcctccgcgaacgagcttcgctctcatccgaagatcttgacgatttagctctccccgacttttctactccccaagaattcctctccatcatcggcgaacagcccattagtaactcccttcaatccaacctttctcttctcctcgtccaggcgcttagatatctcgcccacgtggaggcaggctctttatcggagtcacttaaccctttcaccgaattcttggtcagcaatgtagatcataaagtcggcgtggctgggttctcctcgggaatcctgcctgcctgtgcagtggcatgctctcaggacagcctatcctttatcaaacatgccgtagagcttttccgctttgctttctggttgggacttagatcccaacagtaccagaccaaagcgactcgtgaactgaccaaatctcatggagaaaaaacgcgtcagttttggagtagagttatcatgggacaatctgagtctgaagttagagctgcaatagacatcttcgctgtacagaaccccacgcttccgcaaatttatatcaccgctatcagtgatgacacgacgttcacggtctctggtcgcccggacgctttatctgcattcatagaaacccttccttctacaagccgaatatttaatttgacggtggatacattatatcactctccttgccaccaggacggattgcgagcgcaggttctcgcagatgtcacccgacgtggcgtaatattccctaccctagataacctaatcttccctctccgatcaacttctactggtgaactcgtaaacgagtctaacgacggcacaactctattagaaaacatcctcgatatgatcgttgttcaaccagtcaagtggcacttggtcacagacgctttgtccaaggcgcccccagtcgacattcctattcgcttgttgaactttggacccggaacaggactcactcgttccatggttaaagcattttccaaggacatcgtttccactcaagacttgacctcggagaatgcggccaagcgcctagaaggtgctacgaccgaaggacagatccccattgccattgtgggaatggcattgaacatgcctggagctccgagtgccgccaagttgtgggagttgctcgaaaacggtatcaacaccgtctcggaggttccgtccgaacgcttcaacatctcggagtacaacaagccttcggatcccaaatctaggcgagccatgaaggcgcacaccggaaacttcatggcagacccaagcctctttgatgccaagttcttccgtatttctcctcgtgaagcaaagagcatggacccccagcagcgtatcttgcttcagaccgcttacgaggctttggagaatgccggatacgtcccgaatgctacaccaaccttccaacaggacacctttggttgttacgtcggtgttgcgactgatgactacgttcagaatctcagagacgagattgatgtctactatagtactggtacccttcgtgcgttccttagtgggcgtatttcatacgcaatgggattcagcgggccctcaatcgtcatcgacacagcctgctcatcatcttgtgtttctgtttaccaagcttgtcgggcgttatcgaacggagactgtaacgcagctgtcgctggtggtgttaatgtcattgcaagcccggatatgatgatcggcttggacagggcccattttttgagtcccaccggccagtgcaagccatttgacgcttctgccgacggctactctcgctctgaaggatgcggattgttcgttttgaaacgcctctctgacgccgtcgccgagaacgataacatcctcggggtaattcgtggggttgaggtcaaccaatcaggaaatgctcattcgattactcacccccatgcacctacccaagtcaagctgttcgagaggttgcttgagaaaactggcgttgataggcatcgtatcaacgtgatcgaggcacatggtactggtactcaggccggagatccaaatgagcttgaaagtattcgcaagacttttgctacgggtcgtccaaagtcgaaccctctgcatatcacttccgtcaaggccaacattgggcacctcgaagcagcaagtggttcggctggtttggccaagctccttctcatgcttcgccaccgcaccatcccccggttgatctctttgaagaatctcaacccactcattgctccgttggacttggataacactgcgattgatacagcagcctgcgaatgggctccttcagagcccggtctgcctcgactcgccatgctcaacaactttggtgctgccggttccaatggagctgtactgctggaggaatatgtagcgcctcctcgtgacgaccccataactgcgccgattactttaccctttggtttatctgccaaagattccattgcgctcgatcaactgcgccagcgctatgtggactaccttaggcttcccgagaacgaaggaacgagcctttacgacattgcttataccatgactgcgcgtcgccagatgtacccattccgtatggctgttacagcgtcttctcgccaggagctcgtcgagaagcttctacaggcctctggcactcaagcaaaagagtcgaacgccgaagtagctttcgtattctccggccagggtggtcaatacttgggcatgggtgcggctttgtatgaaacctgccctgtcttcaagacccacgttgacgaatgtcgctcattactatcctgtatgggcttcggcgacatcctgtcaatcatttcgccatccggtgagagaagtgggctaagtgctacagatgaattggaggtttaccaaactgctgtgtttgccttggaatattccctggcacaactatggatgtcctggggcctttctccggtcgcagttgttggtcacagcctgggagaatacgctgccttggttattgcaggagtcctcagtcttcggagcgctctatttgtgatcgcatcccgagtgcgtctcatgcttcgcaagtgcgagatgaatagcacagggatgatagcaatcaataacggccccgctgaagtccaaaagatactcgattcaactcctttgtttgaatctctcagtgtcgcctgctacaacagcgtctcggactgcgtcgttgctggtcctttgacaggattgaaggcactcaagtcttatttggacgatgagatccgctgcaagagtaccatcttgaacgttccatttggataccattccgctgcaatgaacccgctggtggatgatttgaacgcggtcttggaaaccgtcaaacttcatcccccgaggattcctgtagtatccaacgttttcggcagtgtagtagagccaggagatggtaccgttttcacttcgacgtacttctcgcgtcactgtgccgagcctgtcaaattctcagatgggtttgccacacttctggccgacgcggaacttgctgccaatgtttggattgaggtcgggcctcatccgacaaccctacccatgatgaaagcatgccccgctctgccaaaggatattcgccttcttccttcgctcaggaagaaccaagacccttggagtactctcaccacctcattgagtaccctgtatgcagaaaagtcggatgtcgcttggaggaatgtgttcagtcaccttggcagtgtcagctgtgtcgatttgccgacgtacccgttcactaacgtgaaatattgggtcaagttcgaggagagtgaagccactgtgcatacagccacaccccttccagcgcaacagtcggtcgatacgatcaatcaattctcacttttgcgttcctgggttcagcgcccatcaactgcgaatgggaacgtggcaattgtggaggttcccatcagcgtcctctccaagctcattagcggccatcaagttggtgaacatcctctgtgtcccgcatcggtttaccatgaactcgcaatggcagctatcaaacttgcgacgacgaataaaccaggacattacatcgccttacgggatattgactatgctaagcctttggttcatgctgagaacgacaccaggaatatcaggaccgttgtctctatccctgatggtagttggaaggtcatctcgcacagcagcgacgaaagcgtacactgcaccggaaagttctcctgggataacgtcggaaaagctgccctcaaattccagcagtatagacccattctcagccgggaaatcgcctctgtcattgacaatgtagattccgaacttttctcgactcgtacgatgtacgacatcatcttcccgcgtgtcgttcactattccaaagagtatcactccgcacgatgccttactgttcacccttctggtatggagggtcatgctaccgtcaaaatcccacacgcgtcaacccccggtcagtacgtcgttcatccggtcttcatggacaccctccttcacgttgcaggtttcgttgcgaatatgcgagccggtgccaatgacgctttcatctgcagccaggtggactctgtcaaggtggtccctgaactggtcaataatgatgcgacgtacgatgtcttctgccggaatgcatggcttcctgaggagggactcattcttgcggatgcctatgccgtcaccacgggtacctctccgaaaattgttgcccatttgaagcgtatgcatttccgcaaagtccggctcgctagtctcaagcgagctttgaaacatgctcaaggcggatccaccgctccgactcgcaccgccgcaaagtctgcatcatcggttgttgctgcaaagacatcagcatcgcccgcccaagtcaaagttcgaggcaagggcgaggatatactagatcaagtccgaaaagccgtcgcagatacctgtgacgtcccgatgacttcaatggacatttctgctgatctcacctcctttggtgtcgattctttgatgagtatcgagatatttggtcggcttcaagcgttgttcccagatgcagaactagatccacgagtcctatctcatctccgtaccatttcggaaatagcagcagaagtggcgtcgaaggctggtgatctttcaccagccgctacctctgaggcagagtcgtcatcacctgctccatcgactccctccaactgcgggggcaatgttttagatcaggttcgtcaggcagttgcggacacttgtgacctcccagtgacctcgatgaacatctctgctgatctcacttcccttggagttgactccctgatgagtatcgagatatttggtcgacttcaaatgctgttcccagatgcagatctagacccacggatcctatcccatctccataccatttcagaaatcacagccgaggtgacgtccaaggtcggggatgcttcgctggctactacccctgagtcttcgggaacagctgttgaggatgtcgttgcagatactatggtcatggaagagcaaggagccgatgtgaagacggtaatagcaggtgtgcttggtatcggcgccgacgaattcaacgacgacactgacttggagtcgctcggtctggattcactgacatctattgaagttatgcaagcagtgcaggacaacctctccatctctattcctcaacaccttttggcctctcatcccacagttcgagcaatcaacgaatttgtttctagtcaacggaagccgccaaaaaccgaagcacaaagtggtaacgtcgccaaggctccagtgctttctgccgccgccttgaaagctcttgcgctcgatgaaatgccagccccgcttatacgagatccaacatcccagaggacccctcttttcctgattcatgatggaagcggcttggccaactactacggtcggatgtcaagtgttcagcgcaatgtttggggcattttcaatcccaattttgcgacatcggaaccttggacagacttgaagacgatggctgccaagtatgcgtctataatttccagcacggcacgcgggccagctatcatcggaggttggtctttcggtggtgtggtagctttcgaagcggctcgccaactgatgtcggccggccattctgtcaaaggggtcgtcctcatcgattcgcccagtccagtcaatcacgtacctctctcggacgctgtgatcgactcggttgtgaatttagacagtcgtgcagccaagtcagacatcagtcgattagtcaaacgacaattccagatgaattccgcaatgttagggaagtatgaaccatcgacaggtggccattatccccctctcgttctcctcagatcttcggagggctaccaacgccccaacgtgtctgttccgatttggttgagcgaccgaagcgacccccgacaagccgtcagtggatggcaacaggttgttggtactgaggttagagtgatggatattacaggaaaccacttcgagccatttagccctgcacatatcccctcggtttctcaaagagtttcagaagcatgtagttatcttgaatctctctaa

SEQ ID NO: 206 - DNA, 756 bp, Moniliophthora roreri
atgtcttctccattgtcaggcaaagttgccatcgtcactggctcttcccgttctatcggtgcctctatcgctaagcgccttgccaaggatggtgccaccgtcgttataaactacgtttccaacgccgacgctgcaaacgaagttgtcaacgacattaactccaagggcccaggcaaggccgtcagtatccgagccgatgtgtcaagtgtggagggaggaaagaaacttctcgacgagactgtcaagcagctcggaaaggtcgacattctcgtattgaacgccggtattatgggaagcaaagtccttgccgatgtcgacgagcaattctacgatgaccacatgaacatcaacgtcaaaggacctttgttcttgacgaaggctgctgctccactactcccctctggtggccgcgtcatcttcttctcaacatcgttgaccaaggcgtccgctgtcctccccaatgctcttgtctacgtagcctccaaagctgctattgagcaattatcacgagttctcgccaaagacctcggtggtcgtggaatcactgtgaacaccgtatctccaggaccagtcgatactcctttgttcagagcaggaaagccagaacaggttattcaattcattgccaatcagaacccctcgaaacgtctcggtcaacctgacgatattgccccgatagtggccttcctgtcaggtcctgaggctggctggatcaacggccagaacatcctggttaatggagcgttcgtcgtgtaa

SEQ ID NO: 207 - DNA, 1167 bp, Punctularia strigosozonata
atgtcgcgccccgctcgcatactggacaatgcgcttggcgctgtcggtaacacgcctctgatccggctggacaagatagcaaagcatgagggcctgaagtgcaatctcttgggcaaggtcgaatacatgtcggccggtggatctgtgaaggatcgaatcgcgaaggcgatggtggaagccgcggagcgagaagggaaattgattccgggaaagagcgtggtgatcgagccaacctctggcaacacaggcattggactcgccatggcgtgcgcgatcaaagggtattccgtaattatcacccttcccaacaagatgtccctggagaaagaggctgctctccgcgccctcggagcagaagtcgtccgcacgccgaccgaagcctcatgggactcgcccgagtcccacataggcgtcgctgagcgacttcagcgagaaataccccatgccataatcctggaccagtatcgtaacgtgaacaacccgctggcccacgagctcacgacagggccagagatcatcgatgccgtggtcttcacaccctccaccgtggagaagccatcgtcccagaaggtcgatgtcctcgtagcaggcgccgggaccggcggtacgattaccgggctctcgcgtgcagtcaagaaggcacataatccaaggtccgtcatagtcggcgtcgatcccaaaggtagcatccttgcccaacccgagacgctaaatgacgaagaccgcgggatctcttacatcgtcgaaggcattggctatgactttatccccgacgttctttccagagttgagggtgacatcgatgagtgggtgaagacttccgacgaggaagcattcgctgctgtgcgcctcctgatgagacacgagggccttctcgttggtggctcttctggctccgctctcagcggcgctctccactggctgaagacggagaaggggcgcaagatcgcggagactaccggactcaacgttgtggtcatattgccggacggcatccggaactacatgagcaagccgtggttcttgaaaatgacgttggaggccgagagatcgccgttagcagatcagatctcgaagattttgaagcctacatcgtcggatctctgcgcggacgctccagagcggatcgccgacggcatttcggagggaatgcaaagcggcctataa

SEQ ID NO: 208 - DNA, 432 bp, Punctularia strigosozonata
atgccgcgagtctctccgtggcgaatacgtgccggaaacggggcagaaaactgggcgcaaaaacgctggttgtcgtttcaacaggattgtctgaaaagatggacatgccgcgagcatctccctcgtcggaaagcctctaaaccgcggggtggagcgctgctacgaggcgcgaaaattgcgtcccgtagccgcttgcgcactgcacagccattgcaagcaaggaagcggaagtccgtgcgggcccgaagtcggaaaacgacgcagctggcggcgcgagttcgtcgtcgccatcacactgtggcgtcaaactccttcgcgcgggttcggcgggcgcatacttactacgtatatggtgttgtcatactggtccgggacgactgggacgaagcggtaccgccgctaaacttgtttcaatgccgatgcgcagtttga

SEQ ID NO: 209 - DNA, 246 bp, Punctularia strigosozonata
atgctccctcgcgtcaaaaagcccatagaacagttgctgaagcggccgagagggtccgaagacgatgctgctcataaatcgcgcccatacatcaagactcgctccattccaccctgttcttcgtcgcgaaacagataccacgagtgcctatcatggtacgagccccagctgacgaccagcgctgaaactctcagcaaaatgaacgagatagccgggcgagaacttgagcttgtccttggcgcatag

SEQ ID NO: 210 - DNA, 729 bp, Punctularia strigosozonata
atgagcaggaatgatactgctctccatgcaaacccaccgcctcatcctgtcatccggggctctcaggagcgatctccgagctacgaaccgtgcgcaggttgccagtggccacccagcaacagcagaccacaggttcagcctggatacgacacggctcctcaatatgtggcttggccgccgacccatggttcaatagcgcaacaaccgatgtatgcgcagcctatgtatggacttgacacaacgtacagtaacagtggcacgatatcccccacctcgacaaattttcctatcactcagaccgcatcggcatcttatgctcgcatgagcgaaccctatggtcaattctctcctgaggttactgtacccgttgtgcctagtcaacgagacttggacccactagcgtacacgacgcacgatggcaacggatcgccgttcaatcaccaggtgccaaatgttacttcttccggcgcgacggatgaccggaggcaagagtctgctgtggaggcagtggaactgcataccgggcgatgggcgtgccccaaatgctacccgaccagaacgtacgcgcggcacacggaatgtcatcgccatatacgcgatcaccacttgaatctacctcggcatgaatgtccttactgtggcaagacgtttccaccggctcggaaggagcagttgagcaggcacgttctcaaggaccaccctgagtgggctgcgagctgggtcgtctag

SEQ ID NO: 211 - DNA, 1083 bp, Punctularia strigosozonata
atgtctgacagcagcgaggatgccccgcgagtaactcggccccgccgaacggatcctcatcgaatcggcaactggaagattgggcgagtaatcgggcagggcagctctggacgcgtacgggttgcgcggaactctatcactggccagcacgctgcggtcaagatcgtctcaaagacatcggtgtttaactcgcgcatgtctggcatatgcgaactaggcgacgatgcggaccaaattctactcggaatacaacgagagattgttatcatgaagctcatcgatcatccgaacatcatgcggctctatgatttctgggaaacgtcttcggaactattcctgatcttggagtacgttgaggggggcgagctcttcgagtatctgtgcaagaaaggagcactcccgactgcagaggctttaggctacttccaacaaatcatctgtgccgtggactactgccataggttcaagatcgcgcatcgggatctcaaaccggagaatgtgctactggacaaggataagaacatcaagatagcagactttggtatggcggcttggcaagtgcacgacaaaagcgggctcctacggacggcttgtggcagcccccactacgcggccccggaggtgatacgaggcgaggcttacaacggttctatgtctgacatctggtcttgtggcatcatcctctacgcactgctcatgggaaaacttccttttgacgacgaggatctcaccgtgctcctggagaagatcaaatctggcaagtacacggtgtctgctagcatgaatcccctggccaaggaccttctggcacggatgctcgaactcgacgtcaacaaacgaatcactatggataaaatcctgcttcatcctttcttcgtgtctcagccacccaagcaaacctgctcaagctcggtgccaggcctggatgctctcgaccgccccgtcggaggactgcttgacgtcgaccctgaaatcctccggaatctctgtactctctggcacgaatcctctaaggcggaagttcttgagcggctcgcaagcgacgaacaaaacctcgagaaagacatttaccgtctcctctaa

SEQ ID NO: 212 - DNA, 204 bp, Hydnomerulius pinastri
atgaagcccagccacatcgctcgcgccactggcatcaatgcacggacaattcgacgaaccctggaactctggtggaagataggttcagtgcaacggacgccaattgagcgaggtagaaaagagaggttgaatgcacttgatattgcagtacatcccgtgctcgtcccccttgccaagactacaagacggaaagcttacatctag

SEQ ID NO: 213 - DNA, 1383 bp, Hydnomerulius pinastri
atggacccctcgcggccatggctcttgtttgccgagtggcacaaacaatatggacctcttgtgtatacgaacatcggccaacccatgctaatcatagattcagaaagcattgcacgagaattactcgagaaacgctcatccaagtattctagccgccctcaaacccctacatttgatctatatggctgggggtggaccacagtggttttaccttacaatgaccgatggagacaacaccgacgattttacatgcatggctttcgtcccgacgtcgcggtacaatggcgtccatttcagttgcagaaggctcggaccttgctgctcaaccttttaactagccccatggaccacgagcagcatatttctacattcactgcctctacagttatgtctgttacttttggctataacactgcgccacgcgatgacccacttgttgaggtcgtcaaccaagccatggtcctcttggtaaagggcagtgcaatttcgaagatcatctttttcaccatgttcccttttctacaataccttccaacgtggttgccaggcctcggcttttatcgtgatgcacaggcttctcgaaaggtttcacggcttatgttggacgctccgttcgagtttgtgaagaaatccatggctgatgggaaggcacaaatatcacttgtttccgaatttctttcccgtcaagatgaggacggtggatcatatgatggcgaagatatcgtcaaggaggtagccgcaagcggattttcagctggcttcgaaacgacttcttcatatttgatggccttcttactggctatgaccatggactattcgatccaggaacgagctcaagctgaaattgatagcgttgttgggaaagggaggcttccagactttgacgacaggccatcactcccgtacgttgaagctctgctacgtgaactaatgaggtggcaccaagtagccccatttggcgttgggcatgctgttaccgaggacgatgtctacgacggtgttttcattcccaaaaacacaattgtcacggtcaacatatgggctattgcacacgacaagtccaagtatcctgacccacacacattcaacccttcccgcttcttgacgccggagggcaagctgaatgacgacgacatgcacgtcattttcggttttgggcgtcgaatctgccccggtcgccacctcgcagcagcatccttgtgggccgctattgtctccatccttgcgactttcgacattcgcaaggcgaaggatgagaaaggcgatgacattgaaattacgcccattttcgcgccaggggcgacctcccgtccccttccattcccctgtaagatcacgccaagatctgtggaaacggagaacttggtaaggatagacgcctag

SEQ ID NO: 214 - DNA, 252 bp, Hydnomerulius pinastri
atgcaaagtgtgctccaccttcgacacatctggccgagacttcggatcagatatgctcctggtttcgttagccagcaagccatgcccttgaagtaccgcccgaacactgcccgaacgtcacaagctcgtggccgccgcgatctttgctctctcaaaaccaccctcactactatgctcgcaaattttctcctgcagtgggtggccttcacgccagccaaggaaatgacatcctccgtaccaagagaaacctga

SEQ ID NO: 215 - DNA, 681 bp, Hydnomerulius pinastri
atgtctctcatccgcctgccgttcattctctctgctgcccttggcatgcaggtcgccgtgacagccccacacaccgcggctcccgatgaacaggtgaagtcatccactttccgcgaggcgttcctcgctcgcacagcgatcatgtccccattattcactgtggctctcatctggtccgtcgcactcctagaaatatctgccatcctctctccataccttccctataacttcccatcattgcccgcgccaacaaactgtcctcctgtgttcatcgtcggcagcctcctcgtcacaagtgcaggtcttttgcgctggcaatgttaccgcaccctcggtcgtttcttcacctttgaactctccgttaaaaaggaccatagactcgtcacccagggaccgtattccgttgtccggcacccaagctactctggcacactcttgctcacgactgggatgttgcttgtgaatgcccatcccgagtcgtggttgaggacgtcaggtgtcttggattttactccgcttaaaataattctcctgggttgggcaggtgtgacggtcgctatcgccaccagtctattcgccagatccgctcacgaggaccagctgatgagaaaggagtttggggcggagtgggatcggtgggcgagtacagtgaggtaccggatcatacctggcatctactga

SEQ ID NO: 216 - DNA, 681 bp, Hydnomerulius pinastri
atgtctctcctccgcctgccgttcattctctctgctgcccttggcatgcaggtcgccgtgacagctccgcacaccgcggctcccgatgaacgggtgaagtcatccactttccgcgaggcgttcctcgctcgcacagcgatcatgtccccattattcactgtggctctcatctggtccgtggcactcctagaaatatctgccatcctctctccatacctcccctataacttcccatcattgcccgcgtcaacgaactgtcctcctgtgttcatcgccggcagcctcctcgtcacaagtgcaggtcttttgcgctggcaatgttaccgcaccctcggtcgtttcttcacctttgaactctccgttaaaaaggaccatagactcgtcacccaggggccgtattccgttgtccggcacccaagctactctggcacactcttgctcacgactgggatgttgctcgtgaatgcccatcccgagtcgtggttgaggacgtcaggtgtcttggattttactccgcttaaaatatttctcctgggttgggcaagtgtgatggtcgccatcaccaccagtctattcgctagatccgctcacgaggacgaactgatgagaaaggagtttggggcagagtgggatcggtgggcgagtacagtgaggtaccggatcatacctggcatctactga

SEQ ID NO: 217 - DNA, 4236 bp, Hydnomerulius pinastri
atgaccagcactgtgacctccggtgagaaggtcgactctgactcggaacaggtcttgaagcatgtcctcaggcgcgacgagaacaccgtgtctcgccagctcggggtggctttccaaaatttgcgagtagtcggcgtcggcgctcgctcttccttccagcaaacaattacatccgtccttaatccgctcgttatatggaagtctctcgtttcaatcagaaatcccccactgcgtgacatcctttcaggcttcgaaggcgcggtcttgcctggtgaaatgctcctcgtgttggggcgtcccgggtctggctgtagcacgtttcttaagactctggcgaaccagcacgccgaatatagatccgtcgaaggccaactccattacgattcgttcacgccgaaagaaatcggacagctttacagaggagacgtgacgtactgtcaagaagatgacatccatttccctacgctgacccttctagaaacactttcctttgcctcaaagactcgggctccgcagtgtcgcccgggaaatcagtccagacgagagtttgtggacgaacaagttaatgcgcttctctccatctttggtctggagcacgccaggaataccatcgtgggtgatgcaatgcttcggggcgtttccggtggggagaagaagcgactatcgctggcagaagcactggcgttgagaggcaagatcggaagctgggacaactcgactcgcgggctggattcgtccacggcggtggagttccttcgtgctctacgggtcactactgatactacccgtgctgcaacgatcgtgtcgctctaccaggctggcgagccgttatacaatctgttcgataaagtgtgcgtgatctcggagggcaagatggtttatttcggacccgcggcggaagcaaagcagtacttcgttgagatgggttaccagccttacaaccgacagaccaccccagactttctcgtatccgtgacggacgcgaacggccgcgaggtgatccctggctatgaatcatctgttcctcggactgcgtcggaaatggccgcttatttcctatcatcgaagcacggagagctaaaccgtgcatctgtcaaggagttctgcgccaaacgtgtcggaaacgaagctctgagatcggaatataggaccagcgctctgctggaacactctcgacatgcatctgctgctagtccatacatcatctctattccgatgcaggtccgtgcggcgatgctacggagagtacagatcatgaagggtagcgttgcagtgatcatcatcgacatgtgtgcgcaacttttccaagccattgtcatgggcactacgttcttccggctggaagaagcgacttcggcgttcttctctcgagggggtatcatcttcttcgcactgttttttggggcggtatccgcaatggcagagatacctggtctgtttgcgcagcgtcggattgtgctgcggcagcaaaaagcagccatgtaccaccctttcatcgagagcctgtcgtatgcgttagtcgacgtccccatcacgttcatcatccaggctttgttctctatcgtgatctacttcctcgttggtttacagaagacggctacacagtttttcatattcctgctgttcgttttcacggtgacgttgtgcatgaagacgctcttccgggcgatcgccgcatcgctgaggtcgcagatcgctgctcagtcccttgctggaatcatcatcgtcgtggcgattctctatgctggttacacgatcccgattccgagcatgatcggagggttgaaatggctgtcctatatcaatcccatccggtacggatttgaagcgctgatgttgaacgaattccatacgatcaacgggttgtgttcgtcgctcattccacaaggaccaggctatgagaacgtgtcggtcgccaaccaagtgtgcaccacagtaggttctgtacccggggaagcgtacgtgagcggaagtacgtttttggagctctcgtttggatatgcgtacgggaatctttggaagaattacgggatcgtgtgtgcattcgggctcggattcctcgttatctatctggtcgcgacggagatcaatacctcggctgcattcgagacctcggtgatgcttttcaagcgtggatccaatgtcaccgttgaggatgaggcggcggccaacgacgaggagaaggctggtgatcggacccattccgcgtccgctgcctcccctacgcctgctgcaagggctggatctcctgaccaggctggcctcccctcggagaagagcgagaaactcggattggcagggaccgtaccaagcatgaccgacgtgttttcctggcaacatgtctactataccgtaccgatatctggtggggagtcgcggcagttgctggacgacatatccgggttcgtagcaccggggaagttgacggcgttgatgggggaatcaggcgccgggaagacgacgctgttgaacgtgcttgcggacaggacttcgacaggtgttgttcgtggagatcgctttgtgaacggacagccgcttcctgcggatttccaggctcagactggatattgccaacaaatggacacgcatcttggacgagcgtcggttcgcgaggctctcctgttttcggccaatctccggcaacctcaatccgtccccgtggccgagaaagaggcttatgtcgagaaatgcctggagatgtgtggactggaagcttacgcagacgccatcgttggatcattgggtgtcgagcagcggaaacgggtcacgatcggagtcgagcttgctgcgaagccgaagttgctgctgttcctcgacgaacctacttccgggctggattcacagtcggcatgggccgtaatgactttcctccgcgatctcgctgcgagtggacaggccatcctttgcacgatacaccagccttctgccgaattgttccagctgttcgataggttgttgctcttgcgcaagggtggtcaaacagtctacttcgatgaaattggggaccgcgcgtcaactcttttgagctacttcgagaagaacggagctccacggtgtgatcctgacgctaacccagcggagtacatgctggatgtgatcggcgccggggcgacggcgacaacgtccatcgattgggctgctgtctgggggcgttctcccgaagcccagaagctccagagagagatagaacagattcacgccgaaggccgagagcgtcctgttcatcaaagcgacgttcattccgaatttacgacttcttgggcgcatcaattcgtcaccttacttcgcaggagtttccacaacatttggcgcgatccggtgtctgtctttgcgaagatcgcgttgaacgtcgtcgcaggactcctcatcggtttctcgttcttccacaccaaggatgatgtccagggttcccagaacaagcttttctccatcttcatggctatcatgtgctccatccctttgggccagatggtgcagaccgttttcatcgacgtccgagacgtatacgagatccgcgaacgccccagtcggatgtacagctggacggccctcgtcacctcccaaattatctccgagctcccctggaacatctttggatcctccctgtactttgtctgctggtattggaccgtcggttatgagaccagtagagcgggctacacgtacttgatgtacggcgtcattttcccggtctactatgtgaccatcggtcaactgttcgctgctatgtcacccaatgctctcattgcatccctgctgttcagtgtcatgttcacgtttgtgctcatctttgatggcatcctgcagcctttctcgcaattggggtggtggagatggatgtatcgagtgtcgcctttcacgtacttggtagagggtctattgggacaagcgatcggtcggcagaacatcacctgcgcatcacaagagctcgtcacgctcaacccgacatccgactcgacgtgcgccgcatatctggagtcgtttgttgattcagttggtggataccttatgaatcccgacgcgacggatgcatgccaatactgtccgtatcgaacgaccgatcaatacatgttgaactccttcaacatcaagtacaaccttcactggcgagacgccggaatcatgcttggaacgattgtgttcaatgtcttcgctatctatgcctttacatatattttccggatccatactggaagctggattaattggaaaaagacagcgagtgggaagaaatag

SEQ ID NO: 218 - DNA, 1776 bp, Hydnomerulius pinastri
atgtcaagcgctcctcccaaacccattactgtcctcacccccgagctgtcccgggcactcaagcaacgctcagaaagtctccttgtggatataatcaagaaaaaccacatctctcgttatgtacgcgagtccccctcgctcctctgctttcgaaacaccctacgcgactttactatcttccaagatacaccagcgcccctattggaacattttcgcgatactgttcctctctctgtgtacgacacttacgaacctttcatccgcaagcttgtcgagaaaccttgcaaaaaggtggatgtagaagatctcctttcccccggatacccgtcctatgttgcgttgtccagtttcaccactggaaaggcgccgaagtatttcccaaaatatgacttctcgcgagtcaacccaacagaaggctctatttcagcgacaagcaagttcaattgtctcgtcatgcatcttgggaccaagtggaccattcttgtcgaggatgaagacggccagatcgaccacaagcttccggtctgcacaatctcgtcggggataactcgcaccatgttcaacatgaaagtcgaccaagagcacctagcgatggaaatgaaagttccggcgttgacgtcgcccctagcggtctccttcatcaacaattaccgctcattcatccttatgcatgcgctgtttgccttagcagagcgccgcctagaaaccctgtccacctcattcgggactatattagttgatttggtcaagttcgtggaggaggagtgggacagtatcctcaacagcatcgaaacaggcattctacctgatttcgacggtactgaccatctccgggtctatcttcagccatattttctcgccaacccggaaagggcagcagaacttcgtgcccttggagccgccaaagattctcccgaatggttgaagatgatctggccaaacttcaaggaatactctggtatcatgagcggtgcatacactggcgtcctttcgaaggtacagcggtactggggtccagacgtagccctacgcaccgcaggttatatcctatcggaatgttggcccggtataagctacagcggcgtgaacctctataaactcgctaacgatgagtatttcgaattccttgaggtgtcacagcgcgagataccagacgaagagaccgtagaaacagcagctagcttaattcccgtttggaaaatggaggcgggtagggcatacgagcctgtcatcaccagtcgcgatggcttgtggcgataccgcctgggagatatgatccagatagagggctttgagcccaacagcggttcgcccatcttcggtttcgtcgaaagacgacatgaagagatacgaattggtgatgcaactgtccccgcgaacgtcatcagcaatgccatcctctccaccaccgaggacactataggccaggttacggaattcacttcgttcctcgactctcgagacaatcaagttaccatcgggtatttggttgagattgggggggaaattggtcccaacccgtccctcgcccgtcgccgagtccttgatgcactcatggagcagcatcatatgatacgagttaacatcgaaatgaaaaaaatgaggttgccgactatccgcatcgtagaacgaggcacattcggagcatatcgccattggagagtcgagaatgaaaacgtcagccttgcgcaggtgaaggtgcctgtcgtcttcaaaaacgaggaactgttgaagcaactgctgaaaggggtagtccaggaaattcaggaaccctga

SEQ ID NO: 219 - DNA, 1548 bp, Hydnomerulius pinastri
atggactctgcgcgtagccaaattctgtggttcttgcccctattgggtgcgattggtgttctactcaacagttaccgcaagaaacgagcacatggcttgccttaccctcctggtcctggttttcttcacgctgtgaagggcctagccacagtagactcctcggcgccatggctcttgttcgtcgagtggcgaaaacgatatggacctcttgtgtatttggacgtcgcccaacccatgctaatcatacattcagaaattattgcgcgagaattactcgagaaacgtgcatccaagtattctagccgccctgaatcaccaactttcgaattatacggatggggctttacgacagcgttgctgccttacaacgacaaatggaggcagcaccgacgattttaccagcgcggcttccgtccagatgtcgcgatccaatggcgtccattccagctgcagaaggctcgcacgttgctgctgaatctcctgaacagcccagaggaccatgttgagcattttgctacattcactgcctctaccatcatggcgattacatacggctataccaccgctccgcacgatgatccgcttctcaatatcgtcaatcgcgccatcgctatctttgtcaaaagcacggcaatcttgaacgtcataattttcagcacgttcaccttcttggagtcccttccaacttggttgcccggactcggtttttatcgcgaggcctcagtttctcgggggctctcacgaaaaatgctggacgctcccttcgactttgtgaagaagtcaatgggtgacggaacggcgcaagtatcgcttgtttctgagtttcttgctcagaacgatgagggtaccggcccgcttgccagcgaagagactatcaaggaagtcgccgctagtgggctctcagctggtatcgagacgacctcttcgcatgtgatggtgtttctaatggccatagcaatgcacccctccgtccaagaacaggctcaggccgaaatcgactctgttattggcacaggaaggcttcccgattttgacgacaggccttcgctcccgtacatcgaggcggtcctgcgggaaacgctgaggtggcaacaagcatctccgtttggggccccccatactaccaccgaggacgacgtctacgacggtgttttcattcctaaaagtatgctcaccacaccattgtcatggtcaacatatggcacggctattgcacacgacgagtccaaatatcctgacccacatacatttaacccctctcgcttcttgacgccggagggcaagctgaatgacgacgacatgcacgttgatttcggttttgggcgccgaatctgtcccggtcgtcatgttgcagaagcatcgttgtgggccgccattgtctccatccttgctgcttttaacgttcgcaaggcgaaggatgagaaaggcaatgacattgaaattactcctgcaatgacgcctgggcaggtcgtccgccctgttcccttcccgtgtagaatcataccgaggtcggcggaaaaggagaatttggtcagaatggatgactag

SEQ ID NO: 220 - DNA, 810 bp, Hydnomerulius pinastri
atgcgaaggagccaccgtccaactccaagatgggccaatctttcgcaggtcgcaccatacccttgcatcattggtagtagtgaatgcaactctggaaggctagaacgcttccaactggatcgcagattccagcttgctcgagatcctggatacgaagatgtcttaacgatagggcgaacgcgtccaggcgcgatcttcttggatattggctgttgtgttggcacagacattaggaaagtggtggccgatggttttccagccgaacgtgccattggttcaggcctatatcccgaatttggagagttaggacacaagttgtttagaacaacaacagagagcttcgcagggcattttgtccctagagatgcacttgatcctgccatgctctcggtggtaaagccgttcgatagagctccagactcaccagagcctgagttgtcgtctttgacatcgctgaacccgctccaaggacgcgttagcgcaattcatgcgtccgacttctttcacctcttcagcgaaaacaagcaattacacctcgcacgtgcgcttgcagggcttctgtctccgcaaaccggttcactcatatgtggcgggaattggggcttacctgagaaagggatgatgaaggaagggatatttgactctaggatcgaaatgttttgccactctccgcagacttggactgagctgtgggatggtgtggtttcaagtttcccaagcggacaagtgaaggtcgatgctcacatctctgaaatcgagatggaaggattcaacttctggtacttgcgatggtgtgtaaggaggctttga

SEQ ID NO: 221 - DNA, 4212 bp, Hydnomerulius pinastri
atgtctcgccagctcggagtcgctttccaaaatctgcgagtggtcggcgttggcgctcgctcttccttccagcagacaattacatccgtccttaatccgctcgttatatggaagtctctcgtttcaatcagaaatcccccactgcgtgatatcctttcagacttcgaaggcgcagtcttgcctggtgaaatgctcctcgtattggggcgtcccggctctggctgcagcacgttcctgaagactttggcgaaccagcacgctgaatatagatgcgtcgaaggccaactctattacgattcgttcacgccgaaagaaatcggacagctttacagaggagatgtgacgtactgtgaagaagatgacgtccatttccctacgctgacccttctagaaacactctcctttgcctcaaagactcgggctccgcagtgtcgcccgggaaatcagtccagacgagagtttgtagacgaacaggttaatgcgcttctctccatcttcggtctcgagcatgccaggaataccatcgtgggtgatgcgatgcttcggggcgtttccggtggggagaagaagcgactatcgctggcagaagcactggcattgagaggcaggatcggaagctgggataactcgactcgcgggctggattcgtccacagcgctggagttccttcgtgctctacgggtcactactgatactacccgtgctgcgacgatcgtgtcgctctaccaggctggcgagcagttatacaatctgttcgataaagtgtgcgtgatctcggaggggaagatggtttatttcggaccggcggcggaagcaaagcagtacttcgttgggatggggtaccagccttacaaccgacagaccactccggactttctcgtatccgtgacggacgcgaacgggcgcaaggtggtccctggctatgaatcatctgttcctcggactgcgtcggaaatggccgcttatttcctatcatcgaagcacggagagctgaaccgtgcatccgtcgaggagttccgcgctaaacgtgtcggaaacgaagctctaagatcggaatacaggaccagcgctctgctggaacactctcgacatgcatctgctactagtccatacatcatctctattccgatgcaggtccgtgcggcgatgctacggagagtacagatcatgaagggtagcgttgcagtgatcatcatcgacatctgcgcgcaacttttccaagccatcgtgatgggcactacgttcttccgactggaagaagcgacttcggcgttcttctctcgagggggtatcatcttcttcgcactgttttttggggcggtgtctgcgatggcagagatacctggtctgtttgcgcagcgtcggatcgtgctgcggcagcagaaagcagccatgtaccaccctttcatcgagagcctgtcgtatgcgttagtcgacatccccatcacgttcattatccaggcgttgttctctatcgtgatctactttctcgttggtttacagaggacggctgcacaatttttcatattcctgttgttcgttttcacggtgacgttgtgcatgaaaacgttcttccgcgcgatcgccgcatcgctgaggtcgcagatcgctgctcagtcgctggctggaacgatcatcgtcgtggcaattctctatgctggttacacgatccccattccgagcatgatcggggggttgaaatggctgtcctatatcaatgcatgtcgcttccctcgttattcccttgcgctgatgttgaacgaatttcatacgatcaacggattgtgttcgtcgctcattccacaaggagcagggtatgagaacgtgtcggtcgccaaccaagtgtgcaccacagtaggttctgtgcccggggaagcgtacgtgagcggaagtacgtttttggaactctcgtttggatatgcatacgggaatctatggaagaattacgggatcgtgtgtgcattcgggctcggattcctcgttatctatctggttgcgacggagatcaataccgcagctgcattcgagacctcggtgatgcttttcaagcgtggatccaatgtcactgttgaggatgaggcgacggccaacgacgaggaaaagggtagtgatcggtcccattccgtgtccgctgcctcccctacgcctgctgcaagggctggatctcctggccaggcttacctgctctcggagaagagcgagaaaggtgcattagccgggaccgtaccgaccacgacggacgtattttcctggcagcacgtctactatacggtaccgatatctggcggggagtcgcggcagttgctggacgacgtatccgggttcgtagcaccggggaagttgacggcgttgatgggggaatcaggcgccgggaagacgacgctgttgaacgtgcttgcggacaggacttcgacgggcgttgttcgcggagatcgctttgtgaatggacatccgcttccggccgatttccaggctcagactggatattgccaacaaatggacacgcatcttggacgagcgtcggttcgcgaggctctcctgttttcggccaatctccggcaacctcaatccgtccccgtggccgagaaagaggcttatgtcgagaaatgcctggagatgtgtggactggaagcttacgcagacgccatcgttggatcattgggtgtcgagcagcggaaacgggtcacgattggagtcgagcttgctgcgaagccgaaattgctgctgttcctcgacgaacctacttccgggctggattcacagtcggcatgggccgtcatgactttcctccgcgatctcgctgcgagtggacaggccatcctttgcacgatacaccagccttctgccgaattgttccagctgttcgataggttgttgctcttgcggaagggtggtcaaacagtctacttcgatgaaattggggaccgcgcttcaactcttttgagttacttcgagaagaatggagctccacggtgtgatcctgacgctaacccagcggagtacatgttggatgtgatcggtgccggggcgacggcgaccacgtcgatcgattgggctgctgtctggaggcgttcttccgaagccgagaagctccagcgagagatagaacagattcacgccgaaggccgagagcgtcctgttcaccaaagcgacattcattcagaatttacgacttcttgggcgcatcaattcgtcaccttacttcgcaggagtttccagaacatttggcgcgatccggtgtctgtctttgcgaagatcgcgttgaacgtcgtcgcaggactcctcatcggtttctcgttcttccacaccaaggatgatgtccagggttcccagaacaagcttttctccatcttcatggctatcatgtgctccatccctttgggccagatggtgcagaccgttttcatcgacgtccgagacgtatacgagatccgcgaacgccccagtcggatgtacagctggacggccctcgtcacctcccaaattatctccgagctcccctggaacatctttggatcctccctgtactttgtctgctggtattggaccgtcggttatgagaccagtagagcgggctacacgtacttgatgtacggcgtcattttcccggtctactatgtgaccatcggtcaactgttcgctgctatgtcacccaatgctctcatcgcatcgctgcttttcagcgtcatgttcacgtttgtactcatctttgatggcatcctgcagcctttctcgcagttggggtggtggagatggatgtatcgagtgtcgcctttcacgtacttggtagagggtctgttgggacaaggcaagttcccgtttattccttcaccatcttacccacggcttaactcccatttactagcgatcggtcggcagaacatcacctgcgcatcacaggagctcgtcacgctcaacccaacatccggcttgacgtgcgctgcatacctagagtcgttcgtcgattcagttggtggatatcttatgaatcccgacgcgacggatgcatgccaatactgtccgtatcgaacgaccgatcaatacatgttgaactccttcaacatcaagtacaaccttcactggcgagacgccggaattatgcttggaacgattgtgttcaatgtcttcgctatctatgcattcacatatatcttccggatccataccggaagctggattaattggaaaaagacagcgagtgggaagaaatag

SEQ ID NO: 222 - DNA, 1536 bp, Hydnomerulius pinastri
atggtgtggtttgccagagcttcagagagcacggtcatggactctgcgcgtagccaaattctgtggttcttgcccctattgggtgccgttggtgttctgctcagcagttaccgcaagaaacgagcacatggcttgcctttccctcctggtcctggtttctggcatgctgcgaaggacctagtcacaatggactcctcgacgccatggctcttgtttgtcgagtggcacaaacaatatggacctcttgtgtatgtggacgttggccaacccatgctaatcatagattcagaaagcattgcgcgagaactactcgagaaacgtgcatccaagtattctagccgccctgaatcaccaaccttcgagttatacggatggggcttcacgacagcgttgctgccttacaacgacaaatggaggcaacaccgacgattttaccagcgcggcttccgtccagatgtcgcgatgcaatggcgtccattccagctgcagaaggctcgtacgttgctgctcaatcttctgaacagcccagaggaccatgtggagcattttgctacattcactgcctctaccatcatggcgattacatacggctataccaccgctccacacgacgacccacttctcaatatcgtcaatcgcgccatcgctatctttgtcaaaagcaccacaactttgaagcttgtaattttcagcgcgttcaccttcttggagtcccttccaacttggttacccggactcggcttttatcgtgatgcctcagtttctcggaagctctcacggaagatgctggacgctccctttgagtttgtgaagaagtcaatgggtgacggaacggcgcaagtatcgcttgtttctgagtttcttgctcagaacgatgagggtactggcccgcttgccagcgaagagactatcaaggaagtcgccgctagtggcctctcagccggtatcgagacgacctcttcgtatgtgatggtgtttctattggcaatggcaacgcacccctcgatccaagaacaggctcaggccgaaatcgactgtgttattggtacgggaaggcttcccgattttgacgacaggccttcactcccgtatgtcgaggctgtactgcgagaaacgttgaggtggcaattggcgtctccgtttggggccccccatactaccaccgaggatgatgtctacgatggtgttctcattcctaaaaacaccattgtcacggccaacatatgggctattacacacgacgagtccaagtatcctgacccacgcacattcaacccttcccgcttcttgacgccggagggcaagctgaatgacgacgacatgcacattgttttcggttttgggcgccgaatctgtcccggtcgccatgtcgcagaagcatccttatgggttgccattgtctccatccttgcggctttcaacgtccgcaaggcgaaggatgagaaaggcaatgacattgaaattactcctgcaatgacgcctgggcaggtcgtgtgcgtacttgctgttccatgccatttccctccctctttctga

SEQ ID NO: 223 - DNA, 1521 bp, Hydnomerulius pinastri
atgaacgtcgtgcgcagtcaaacctttctgtggctcttgcccctactgggtgccgctagtgttctactcaacagttaccgcaagaaacgagtacatggcttgcctctccctcctggtcccggcttctggcacgctgcgaagggcctggtcacaatggactcctcagcaccatggctcttgtttaccgagtggcacaaacaatatggacctctcgtgtatatggacatcgcccaacccttgctaatcacaaattcagaaagcattgcgcgagaattactcgagaaacgttcatccaaatattctagccgccctgaagccccatcattcgatctatatggctgggggtggaccacagtggttttaccttacaatgaccgatggagacaacaccgacgattttacatgcatggctttcgtcccgatgtcgcggtacaatggcgtccgttccagatccagaacgctcgggcgttattgctcaaccttttaactagccccatggaccatgagcagcatgttgctacattcactgcctctacagttttgtctgttacttatggctataacgccgcatcacacgatgacccacttgttgagctcgttaaccaagccatggtcctcttgatgaagggcaatgaattttcgaaggttatttttttcaccatgttcccctttctacaataccttccaacgtggttgccaggcctcggcttctttcgtgatgcacaggcttctcgaaagttttcacggcttatgttggacgctccgttcgagcatgtgaagaaatccatggtctgccgcacaaatcttttaacagcgttttgtattaatatgatctatctaaaggcggatgggaaggcgcaaatatcgcttgtttccgaaattctttcccggctagaagaggacggtggaccatatgagggcgaagagactgcttcatatttgatgaccttcttactggctatgaccatggaccattccattcaggagcgagctcaggctgaaattgataccgtcgttgggaaagggagacttccagactttgacgacaggccatcactcccgtacgttgaagccctgctacgtgaactaatgaggtggcaccaagtaatcccattcggcattgggcatgctgttaccgaggacgacgtctacgatggtgttttcattcctaaaagtatgctcactataccatggtcgtgggctattgcacacgacgagtccaagtatcctgacccacacacattcaacccctctcgcttcttgacgccggagggcaagctgaatgacgacgacatgtacattattttcggttttgggcggcgaatctgccccggtcgccatctcgctgtagcatccttgtgggccgctattgtctccatccttgcggctttcgacattcgcaaggcgaaggatgagaaaggcaatgacattgaaattgtgcccattttcgcgccaggggcctcttcgtatgtatctgttttcgtgcattgttcctcggtttctgaacatcgcctgggttga

SEQ ID NO: 224 - DNA, 7959 bp, Hydnomerulius pinastri
atggcacacaggcaacctctagacaatgttgctcgggatgcccccagctacacaaatccagaccctcgtgccgtagctatcgtcggcatgtctatcagcgcgcccggcggtgttgactatggtcttgataccgaagaattctatgctttcctccaaaatagaggatctgccatcattaccgttcctactaaccgctggaacgcggaagcctttcatggcactgggccgggcaagatctctactacaaagggagggtttattcctgacattagatatgccgacctccaagagttcggtattactcctgtggaaggccaacagatatctacttgccaaatgcttctgctccatcaagcgttcacggcgttgcagcgcagtggagttgattatcgtggtacaaacactggggtttacgttggctccgcatccggcgaaggaactttgtttgaaatggacatagcacaggcaggcccgtattacatgactggaacaaccaactcgatcgttgcgaacagactgaactacgtatttgatctactcggtccttccatgcccatagatactgcgtgttcgtcctcgctggcagcgatgcacgtcgccgttcaagccgtccgcaacggtgaatgtgaccaggctgtagtggccggtgccaacgtcgttcgaaacgcactcgaatgcgtagcgttcagtcagttaggtgtgctcagccctgacggcatatccaagtcctttgatgaagatgggaatggatacgcacgtggtgacgtcgccagcgcggttgttattaagcgccatgatctcgccgtcaaagatcacaatcgcattcacgcgacgcttgttggtaccgccctgacatcatgcggatccatcatgggttccctcacaaccccgagtcccgaagcgcaggcttcggcgatccagcttgcatatcgagacgccggtctcgagcctcatcaagcagatttcgtcgagctccatggcacgggcacggttgtcggtgacgcgacagaagcgaataatgccggcgccgtctttgcgggggggagagatgcaagggagatcctcattggatcggtgaagagcaacgttggacatggtgaactaggcgcgtatatgacatcattagtgaaggtcgcaatgatgttggaaaggaaggaagtcctacctaatggctacttcaaaaagccatcctcccgaattgatttcgaaaagttcaagctgcgtgttcccgtgtccgttgagaatttcgcacctggcaatccccaactcggtcggattgcgtctatatctagttacggatttggaggcgctctgtcgctgaagggatgcgttactctcagcgagaaatacaaagaagagtgcgctgaagttgagcctctcgccctgtgcgagcacttggcaaaccgtacacgccaactcccatggaggtccttcgcaatcgctggatccatcgagacagcgacgttccccgaaccagtcctcgtacctaaacgcccccatcctctcgtcttttgtttctcaggccagggcccccaacactggcagcaaggccgggagctatatcatactttcaaggtgttccgcgatagtatcaatgactgcgacagggtgcatgtcgattacacaggggaatccttcatcgagacgacaggcctgttcaagaccgatgctcctaaggactcggacctggctaccagcttaacatggccttccgatgtcacttccatttctctcaccttcttccagattgcgctcttcgacctcttgagttctctgaatcttaagccagatacaattgttggacactcagttggagagacagcagtcttatacgcttcaggcgcggtcccacgtagcatggccgttaaaatcgcgatcgctcgtggaaaagctcttgccatggttgacaacactggcggcggtatggtggctgtttctggatgcgacgcagacaaagtacgcgactacgcggaaacggcaattacactagctgtgcaggaagtcgactcggcgggtggtccccagctgttccttgcgtcattcaacagccccacagatataggcgtatcaggctccaagaaacatcttgaggtatttgcaagcttcatcgaaagatgggtgagcgatgtcgtcgcgcgcaaacttcgcatcaacaccgctgtccactctcccttcgtccatccctgcgagtcgcaataccgccgagacctagctaccattttcgcggagtatccaggtcctcacatcccaaagatcccgacgatgtccacggtcactgctgagttcaaaacagactcgtatacgcccgattatttgtggaacaacctccgccaacctgtgcttttctcttcggctatccccaaagtagttgagagactcggagaattgaccacgtttattgaggtcgcccctcatccagtcctgtcccagtacctcaagcagatgggtgcccttgatgctctcgcctgcagcagacgtccaccgtctgcccgccatgtaaaacctgggtcgagcgctttggtcgaagtacgcacattgctggaagttttgggacgtttgctgttagtcggcgtcaataagatcaacttctcggagtttgccggatgcccagatgcaaacatcgagggtcccgcatatccgttccagccaaagttatggcgctatggcatggatgaaccatcatacgtccgtaagctattacccgcggaaaggtctttgaattcgattcggctacgcgtcagcccaattatgcccgagccgtggatgggtgatcatgtcattgatcatacgaatctggttcccgcggctgcctacctagagatggcccttgagttccccgatgttactcagctgtatgattgccgcttcgaggctatgtatgtcctggaagagtcaggaccacctgggacattggaagtttcccgggaagggaattcctggtgggtgaagtcatcatctcagatgcgcactccgcagggggacaaggagtggacgaggactggtccttctttcgacactctccactcttgcggcaagttgggttatggtccccctgaaatcgagccggatgcgatcacacgcgtcgatcttgaggaagtgctgtctcgctgcccctacacgttcgatcgcgacgcctttaacgatcggatggagggtgtggtacaatttggtcccgagttcagacgaattatgaaagcggtgtgcaatgaaaaggaagtcctgacatatatcaagggtcatgtggatggcctgaatcagacagattatgccttccatcccgccctcttagatgccgtcttccagtcgcctctttcatggggcctgatcggtgataagctgcatctcggtaggaagaatacccagctactgctgccacattctgttcgccgcatattccgcaatgatggcagtactgctccactggtgctgcctgatgaatttgtagcttataccgtcctccacgagtggtcgcctcaccactgggtgacgaactgttatatcttaggtgaagaccagtcggtcatatataccgtggaaggacttcgttttgcgttggtccagcatgacaatgagtggcctagcgaacacttcaagatgttctggcaacctagggacttgccacagtcgcatctggaaagctcagtcattcttcctggtccaccaccgcattccgatgatatagagttatttggtctacctcacgacttcgctcctacctcgcctgaccgccagcgctacttggcttgggcaaatgcggtggccaccagactgaccgcgaacaacgctgatgtgccagcagtccctgctcatttgcaagaaaagtataaagctttgttcgacctgactcagagggtcggtgctggacaaaaagctgccgccgttgagctgcttttctatgacgacatcatgagcaagatctacgagcatccacctttcatcggctctgtattcgatgcgaccacgtcgcgtttcatcgaccttgttaccgacgcactcaatgctggcaagcaggtggtccgagtccttgaggttggtgcgggaactgggaggttcactgcactgctcgggcgagctcttttggaagctgctttgcctgaaggctgctacgtcgactacgtctgcaccgacgtcagtatttcgctcgcacaagaggcgacagcgaagtccccttggccaacggtaaccgccaaagcccttgatctgaatgtcgcgatcagcgaacagaacctagatccccgcagtttcgatattgtcgttgcctttgatgttctgcacgctatccctgacattcacgcgagtttgacgacgctccagcagctcctctgtcccggcggtcacattgccatcttggagttggacggtggttccaaacctgtactgctccgacacttcaccgctggaggggaagttgcccttgtcgacttcatatcatcgctggattcaacatacccctacctcttctggctatacaccactacttcccccggcgatgcagctgcggttggactagtgagaactctccgccaggaatacccaacctggaagattcacctcgctctcttccccgactcctggacggtgacagcccaagaggcttatgtgcactcacagctcatactgttgccgtgggtggactctgaagtgatgattgaccaggacgggaagatgcacgtgccgcgtctggtgaaggcctctcccgccgctcgccaggaacttcggggctctcatccagtctcattccggggttccgatgtctggcgagcgtacccagcggagcttggtccgaatgatgttgaagtgtccgttcactatgttggattgactccggctatgtctggatggaccgaatttgctggagcggtgacagccgtcggctctggtgtacttgaagaggacctcgtcgggcgcagggtatttggtgttactgtttctgtccccggaagtaccatcgtctgcgatcgttccaagcttgcgttcgttcctcaagacatggaaactgccctggccaccgctttggtgggaaggcttatgttcttatcattggtcgtggtcgataccgtcggcacctcttcgaagaacacaaaggtcctcctccacgctggccattgttcaccggccgcgctcgcgacatacgcttacctaagtgccaactccttcaacgttactgtcaccgtcagcgatgcaccaccgtccaccaacaccttcagcacgctgtccccgatttcatcttccaaatactatgcctggtcatctcgtgtccgcgcttgggctccacgaggcgtagacgtcgtcttcaattttgacgaggatatcaacgtggcgaagcaaacgctttccttgctttcttctcgggggagatttgttcaaatagggggagagctgcccagctctcttccttccggacgtcgctacgtatcaatcgaagagcatgctgttctagaagctggcaatgatctcgatcgcaccgacgctgttttttcacccgctgtccttgctgccctacctcctgccgtggacatttacaacctcccacagctcatgaccgccgacgtccaagcacgcaactcgatgccaggccgtgttactctggtcgacctgcaagcgattccccaggagcttcccgttttgaaagccggaatgttgaaagggacggctgttttcaatcctcgagcatcctatgtgattgtgggtggtattggcggactgggtgtcaacattgcacggtgcttggtggaaaatggtgccaagcacctgattctgacttcgagatctggggagaagggaatcgcgactatgcaactagcacgcgagaaaaagattgtcaattatcttcgaggaattcctggagtaaccgtcgatcttcgggcggtggacgttcttgacgctgagaagaccagagacttgttcatgaacctggagcatcctgttgccggggtgttctatttggctgtcaggctcaacgaccaggtctttgcgaatttgaagacggaggaagactggaaaattggcaagtcggctatcttgcgctttatttacgacgtcaagatcaaaggcgttgaagttctcctgcaagcggtcaaccctcagtcactggatttccttgtcctcacgagttccatggctactgtgtgcggctcgccaggccaggcgaactattctgctgcccagacctacatggagaccatggcggcagcgcttcccaataccgttgcaatcaccgtgccccctatcaccgatggaggtgtgtttgtccgaagcctgcctccaggtaacgcacgcaatgcagccctggacaaatacaaatccctcggaatgactggctaccttgttgcgcaacactgcgtgaatgccatctggacgctgaactgcgatgcctatagcccagtctatattcctcccaccgactggaaagagatcatgcaacttggcatcccggaataccacttgtcgtccctgcgtcatttgttgaccaagcaaaacgttgagatcgcgctggcaaccgaggagtggtccattcgggcggcgtgcgcatcggtgttggctcttgataccaacgaggttgcagacaatgtcccgctttcaagctatggtcttgactcgctaacatccgttcgattgagtgggattctcaaaaccaacttcaatgtttccgtgactcagcttcagcttctcggaaacagtatgactgtccaacgactgatggctctgcaagaggagctgaaggccgattcatcttctgtggctgtggggactgccaacaaggactcgctcgacatactgggagccgaaggtgtccatcatgctgacatggacaagacgatcgttcgattgaacaacgtcacggatggacaacctgtattcatcgtacacggcgctggcggcggcgtcctcgtcatgctgaaaaccgcggaaatgatgtcttgtcctgtttatggtgtccaagacactccagatgcgcccattaccggaaccctcgacaaactttgcaggttctacctggagaaaatccgagagaagcaacccaaaggtccataccgccttgggggtttctcattcggcacctatgccgcttttgtcatcgcacagctgctgcaagaagaaggggagacagttgagctgctcgtcatgatcgatgggtcgccagcgattttcaccaacttcgccaagaggatcaatgtgaccaatatgcgagacgaaatcatgaccgttatccgtgatcttgccgcaagcgggacgctggaaagtggcgaggaacttaccgccatgtttgaggaccacttcaagcaagttgcgcagggcggttctagcggcaaatttgtgtcccagttcggtcgtgcattcgtcgcacacgtgctcatggcggtccgcgcttgtatcccagcgatcttacgggagcaagctggggagatcgataactctgtctggccgaccgcgagaacggtcgttatccgtgcggaagatggcattggtcgtcaatccgtgtcggaaggactttcccctgcttttgatgtagaattacgcgccccagatgcggagttttacatcctaccgggaacgcacttcgggattctccacccccagtctgggctccctcagcttctcgaacaggtggagaagtgtgatcacccaaaagtgataccaccgacgatgacgatgatgaccggaactacgatttctgtgggaaaacacagaagtcagtcatccatcgacttaggctgctctgacacggcgagggcacaagctgcgaaagaagtttccgggatcatggtgtcatcaatgtggaggagctggacagcgaagagcaccaagggtgtgacagcttcggcattctcagacagcatcagggtctccgcctacaatgcgtcccccagtaggctcctgctgccttcattgggggctaatgcaggccctcaatgcgacggcggacgaaaatggtaccaggccccaaaaatgacctag

SEQ ID NO: 225 - DNA, 1551 bp, Arthroderma gypseum
atgccgcgcttcaaccccctaagcatctcctgtctggctactctgctgaccacctaccttggtacagcatctgtatctgcacagtcaccaccccaggaaaccctctggccggtgcagacgttccagagtacggatatccagacgccgtttttcaatgtgacgaagaaaggccagacggaaccgggctatatcttcataagcccgagagataaggcccgaaacattggacatccagctatcctcgaggacaatggccaggttgtctggaagggaccggaagacgcgagcacatatggcttcaagcctcagcttcttgacgggaagccagtgctggttagctggttcgggttcgtgaacgagactggattcggactgggatctatgagcatcttcgacagctcgtatgagaagatccacgaggtgattctgcccggtggtgataacgaatactacaagacgatttatgagcccatgacgttcccatcatacatggacaaccacgaaggccagatcacggaccaaggaaccatcgttgtgactgttgtcaatgtcactgaggcagatctccgtgctgttggcgggcctgagaagggctgggttgtcgacggaggctttttggaaatggacatcaagaccaacgaagtcctcttccgctggaatgccgctgagcacattgatgagatccctgtcactttctcccttaagccaattgagggaactggaacttcgcccaaaaacccatggaactacgtccatgtcaactccgtcttcaaatccggagactcttatatcgtctcttctcggtactcctgcaacatcttcctcatctccaaggaaggcgagattgtctggcgcctcaacggcattgatggaggtgacttcgagctaggccccggcgccaacttctgttaccagcatgaagtcagggtcgaatcccacaccgtggacaagatcacgctgactacacacaacaacgacaacgccgacttcacgcctgccaatgaaaccaaaccgacaaccggtctggtcctcgatctcgatctcaacgccaagaaagtcactttgaaccgcatggtatggaactccgagcggcctgtcgtctctcggggccaggggagctaccaggtgcttggcaacgaccacgtcctgatgggccagggcgccatccccatcgtagaggagtacgatgccaacggcgccgtcgtaatggacgcccgtttcggcaacgacggcgtcaccaactgctaccgcgcctaccgcagcgcctgggttggcacacccaagacgaaaccgagcgtaaaggcctgcggtgccgatccgaacggcgcggtggtgttttatgtgagctggaacggcgcgacggacgtagagtcgtggaagattttctctgtctcggactctggcgagcacagtgagatagctaatgtgccgaaaaatggctttgagacgaggatggagctgcagaaggctggcagcaagttcatcgtccagtcggttggaggacctaacgacggggtgcagtctgatgttgtcatgggcgaaaactgctag

SEQ ID NO: 226 - DNA, 1860 bp, Arthroderma gypseum
atggacgacttgctggctctcgtcgagggtggccctgcgctcaagccgacgatcaactcactctggacagccctgcaccagcgtgccagcatacagccagacagactggccctgctgagcccccggcagcctggaaacttgctcgaaggactcgtccggcctagaggaaggagagatgagagtggcagccgcgatgccctcatgcgtagcctcaagcgagcagccacaccggcgtacatgctcagctacctgctatcgtgggttctgccggcgcctgatacagagacagactacctcagatggtcctttgcagagctccaacgtgcaacaattcgtctagcttcttttctgcgtcgtcgtggtgtgaagccaggggcgacaggcgccttcttcaccccggtctgcgcagaatgggcgttgatgctgtctgtgtctgcgtacagtcgctacacgggtgtgacgctcgaccggaagacgctcgcgcctggtaatgagcacgacctgcgagtacatatgaacacactaagcccgtctttcattatcgttactacggtagaggaagcgctgcatcttgctggacagacagatgtagcactcgggatctgcttggagaacttcgcgacgcctgctccggagggctggctgagcatggcagatattgcagcatcctcatatgaagaggaagaggaagaagaagtagaagaagcagaagaagtggaagaaaagagagaaagtgacaggacagccttcgttgtgtttactagtggctcgtccggcatacccaagggctgcccagtgtccgccagccaaattctatctcttctcggagctgtgtccaagcagatgcctctcctaccaactcctatgactcttgtctcgggcacatgcttccggtcgctctgcacagccatcacactgatgtcctgggcctcaggcaacgccgccgtcatggacgccagcaacgaggcgacagctgagacgaagctcgctgggctgcaaacatgccgacctgcctttgcctccgtaaccgtcacggcgctctcctctattgcccgtagcccaaactacaccgccgacgccatcaggtcggtccgcttcgtccatctcatcggctcaactatgaccgcgtcggtcctccgaagggccaagaagacgttccctcacgcaacgatcctgcccagctttggcatgtcagaggccgcaaagacagtgacctgggaagctgccggaggtgtgccatccgttgacaagatacctacatggcacggcatcgccgcctcaggcaaggtggctcccggcgaaaggctcaaggtcgttgatatagacggtaacgttgcacgccgtaatcatgttggtgcgttacacctgagcggcgactcagttatcggtggttacttgggtggtgccaattctgctgccttttacgtaggagacgacggccaccactggttcgtctctggggacgatgccgtgattgatgaccaaggccttctctatgtcctcggtcgaagtgagtatactctcaggcgcgacagcaagctcatcctcccctgtatcgttgaaaattttctcgagacgcaattcgaagggtcctcggctgccgtagtgaatatcaccaccagcaacggtgataggggtttatttgctgtcttagagcacgctgtccctgcccctgcatccgctgctgttcaagaacttgtcgctcaaaagcttggcttggaataccgtgtcgaaggtgctgtgagcctcaatgagctaggattcgagaagtggccgctgacctcgggagaaaaagtcgcctaccgtgatttacggctcgccattgaggaatttctcacttccaagacggcaaatttatga

SEQ ID NO: 227 - DNA, 6939 bp, Arthroderma gypseum
atggagaagccgatgcctattgccatcattggcatggcatgccgcacttcgggcggcgttgcttcattagatgaattctggacgatgctctctcgctgcagagacggctctggtccgattccaaaggacagattctcctctgctgcatactatcaccccaatccgcaaaagcgaggcacattcaaccagcttggaggctatttcatggacagagatgtgtcctacttcgacgccccgttctttaatatcacaaggcaagaagcagcttcactagatccgctgcaaagacaactcctcgaaatctcatacgaagctctagaatgcgccgggcttcctaagaacaagatatcgggagagagcatggccgtcttcgttggtactaagagatcagactaccgatgcaactcacaggacgtgaagcgaattgaactgtttaacgcaacaagcgttcacccggccgttcaggcaggccggctatcctactacttcaacctcaacgggccctgctgcgccgtcgacacagcctgctcttctgggctgcatgctctccacctaggcgtgaatgccattcgtaatggagagtgcagttctgcgcttgtggcggctgctaatttgtatctcaacccggatgacctggtatccatgtcgatgctgggcctatttactcctgcgggcaagacatacgcctttgaccaccgcggaacgtccggctttgcctgcggcgaaggcgcggcagccctcgtcatcaagccgctggatcgggccattaatgataacgacaacatctactctgtaatcgtcaacacaggaatcaaccaggatggcaagacggctggtctcacaacgccgagcagtgaaatgcaagagaagcttatgcgtgacgtatacaggcgcgcaaacatcagccctaatgacacagcattcgtcgaggctcacggcacaggcacaaaagtaggagatcccctagaagttgctgccatccagcgagtgtttggcaacgggcgtacaaagcgcagcccgctatatattggctcagtaaagaccaatgtcggccacctggaaaatgccagcggtctcatttccgtcatcaaggctagtcttatgctgcaccgaggcttcatcttgccaaacaccaattttgagaaggcgaatcctgatatcccactggaagcgtggaatttgaaggtccccgtcaatattcgtccctggcccaggggcaggcgctatatcagcatcaacaactttggtttcggcggctctaacgcccatgtcgtccttgataaagcgcctcccgcggttatgctcagagctattcctgtcgagccgccgggcagagaagctatacctaaactctttgtcatttccggtcacgacgagggtgcagcaagaagaaatgccagccaaattggaatctacgtcgagcagcacccggaagtctttgagaagcgcatcgctcgcgacgtcgcgtacaccctcggcgagcgtcgaactcaccatgctttccgcgttgctctcacagcgagcaatttcggtgaactgacagaagatttgaacgatgaggcactactcccacagcgtgcgtcagatgaaccacttaagctagccttcatattcactggccaaggtgctcagtggccgcagatgggcagacagttactcaattctcacccgatcttcggcctgacggtcaaggagtgctccgattttctagagaacagtattggcgctgacttctctcttatgcaagaactcttgcggccaaagggcgagtccatcgttaatgaagctcacatttcacagccaatttgcacagcaatccagctgggtctcgttgagctgctcaagtcctggaaaattgagccctccatggtttgtggccattcgtctggtgagatagccgccgcctatgctgccggtgccattacgctcagagatgctatggccgctgcttattaccgcggtcactttgccgctcagatgaagaaacgcaatcctaaagtccgtggtgccatgttagctgttggcgccggacctgcggaagtaaagagaatcatcaagtctctgagtttagccggcgtcaccgtttcttgtgaaaacgctcccaattctgtaactgcttctggtgacgaagccgacattgacagacttgcattagaacttgaaggacgcagcttgttcaaccgtaagctccgtgtcgatgttgcatatcactctgcgcatatgaagctcgttgcgaacgactacatggcagccattgagaacatgcacttcaaggccatggatgatggtatcaagttttactcgtctcttcttgggaaaaagcttgatagcactgaagcactgggtgctcagtactgggttaacaaccttatcaagcctgttctcttttcatctgctcttgaggagctctacaatgacggaaaaccagacatcatcattgaactcggtcctcactctgcactcgagggccctatcaagcaagttttaaagggaattagcaagcaggctgctacaagcgtcaggtatcattctgctttgctccgcaaccaagatgctgcggttacagccgtcaagcttgccggtaatctttggaccaaaggccttgatatcgacttcagccaggtcaatataacgttggaagggcagttggagcccggcctggtttcagacctaccttcataccagtggtcaaaacatcagtgctggacagagtctcgcgccggcaaatctcatcgccttaaggattttggtcggcacgatctacttggactcctacaggacgactgcaacgaaactgagcctgtctggaccaatgttcttgattctgatgaagtgccatggctcaaggatcataagatgcagtctcttgtcacattcccctgcgctgggtacctgactatggcaaccgaagctgcttctcaaacagcgcggatgcgtggcgtgctgttggaagaaattgcctcataccatatgcgaaacatccaggttagcaagcctttcatcctcgatgatggcgagtcttatgacacacgctttactctcaagcgttatgccgaaggtctggcagcgtattctaacgactgggatgaatttcaatactcctcttgggccccttcccgaggctgggttgagcactgccgtggcctcgttggcatcaagaagcgcagcaacaccaatattgttcgaatgaacaaccaaaaagctgctattgctcgcagggccaatatgcagccacagcctggtactgagatcgattgtgaatcgttctactcagaacttttgggtaagggtgctggatacaccagagacttcactttcaaggatggtgcaaatctgagagtcgatggtgattgttcagctggcatagcagttctccaggatgttgctgccaatatgcctttcaaccatgagacacaaagcactctgccctctgcattaacagacttgatatttcaaacatgtttcttgatcctcggtgcagggcgcggaaatctgaagagcttggtcgtgccatcggctatcggaagtgtcgagatttctaccacatgcccaaatactcccggcgagacgcttgaaatcgtgacccaccaccaaaactttgcttcaaaggaccgattggtatttgacagtgatgcatggcacacaaatgcgagtgagccggtcgttatgatgcgaagcaccatcttgacgcccattcatggtgatgcttttgaaagtcaagagccacggtctgcgtgctatagagtgatctgggaacctttggaagcccaagttgcagccaaacttgaagacaatgccgcatcagatggggcaaataaccattccaactgtcacactaatgggcacagagatggacacgccaatggttatataaacggccatgccaacggcagcaccaatggacatacaaatggccatattagtgggtatacaaacggacacaccaatggacacaccaacggcaacgccagcaacatcaacggcaacaccaacggccatacaaatggtcataccagtaggtataccaatggacacacaaacggcaacaccaacggccatacaaatggtcatacaaatggacacaccaacgggcgtaccaacggttatacaaacggccgtaccaatggacattcgaatggtggctctaatgggtataccaatggtgtgccgacttctggcgttgacttgagcgccactcccatcaccgtcatttgcgatgctggtccctcaaaccctctctgcgctgcccttgcggatctgattgagattcagacgtgtggatgcaggccaaccattatatcactagcaaaagcagagatatgttcatccgtcagatatgttgtcttgaatgaggtcgatagcccggtcctcgatgacatgaatgccgatacatttgctctgatccagaagctcctgcttgatggcttgtctatcctctgggtaagctctggtgcttatctaaatgcagagagcccacataacaacatagcccagggaatgttccgaaccattcgttccgagctgggtaaagtagcggccactcttgacctcgataccaaatctaagttgcggcctgacgatcaggcgcagcttatcatcactgcaatgaagacatccatggaaacattcaaagatgaatccatcgattatgaatttgcggagaaagatgggaaacttctcgttccccgtgtcgtagaagaaaatgagatgaatcttgacctcttccgccaaacccagtctcctcccccttatctccaaaacttcaacgagcccaaccgccgcctcaagatcgcggttggcacatacggtgcgctcgactccctattctgggacgacgaggagacatacgggcttgggccaaacgagattgaagttaaagttgctgctactggcatgaacttcaaagacgttgtcattgccatgggacaagtgcctagcccgtacctcggaatcgagtgttccggtaccgtctcacgcattggatctggtgtcacctcgctcaagattggaaatcgagtttgtgctatgacacacggtgcttatagtacttttgctcgctgtccagctactagcgcagctgtcatcccagaggatattgcattctccacagccgcttctatccccgttatcttctgcacagcctactatggcctgatagagcttgctcaccttgaacgtggggagaaaatattaattcacgcagcgtctggcggcgtgggacaggccgccattcagctctcccagatggtaggcgctgagatttttgccactaccagcagtgttgagaagaaaaaccatcttattgatacctatggtattccggaggaccatatcttttatagtagagataccagttttgggcctgccgtcagagaatctaccgacgggaaaggtgtagatgttgtaatcaactcccttgctggtgatctgctgcgagagacctgggcctgcattgccccatttggccgctttattgaaattggaaaacgtgatatcacctccaacactcgactggaaatggacaaatttgaatacaattgctctttccactcggttgatttgtccaaggttgctgactggcgaccaaagataatgagtcgagttttcaaggaagtcatggctctcatctccaaaaggattatccagcccattagccccatcactgagattggcatctctaaggtcgaagctgcgttgcgcaaacttcagagcggcaagactaagggcaaggtcattgtcaaccatctcgtcaatgagcaggtcaatgctgcccacagacagcctaccggagacctagtgaatggaaatgccacttatatcatcattggcggtacaggtggccttggtcgttccatggcaaagaaaatggctcagcgcggtggaaagcacgtcgtccttctatcccgcagcggcaagatgactcctgagctagatcatctcagcaaagaatgcgagatatatggagccaagatctatgtaaaatgctgtgacgcggccaaccaggcaaaagtcaacgaacttatctcagagctgcaatcgtcactgcctccgatccgtggtgtcatccatgcagccatggtgctgcgggataccctctttgaaaagatgtcattcgaggactgggatgaggttgtgcgctgtaaggttgcgggaggctggaacttccacattgccttagcaaaggagcccctcgacttcttcatcgtcctatcctcggttgctggcattgttggcaaccgcggccaggcagcctacgccgctgccaacaccttcttagatgccttgacagtccaccgccgtaggttgggtcttaaagctacatcgctcaacctaactgcagtcgaggatatcggttatctggcggagaattccggcaagcaaggcgaagttcttcgcaatttatctggtaacggaattggcggggccgaagtcctagcactcatcgagagttctataaacggcaaggttggcaccgcctgcgacgaccagtgtatcaccggacttgaattcggggactcgatgccctactttgccgcggatggcaagttcaagtatcttcgtcaggctgctcttgcgctgagcgctgctgcgggtgatgacggtggcgcgaatattcctattggcaagagactagctagggcgatgacagtgggcgaagccgtcgagcttgttaccgatggcttgcgtgacaaactgggcgccattctgatgcttgaccccgatgtcattctagctaaacaggcgactgtcaccatggctgcccttggcttggactcactcaacgctatcgagctgcgtaattggatcgcaagggacctgcagacacacttgcagatcctggagctgctgcgagctggaacgttggctgatcttgcaagtcagattctgaagaagactcgcatccaaggtgcttggacaatgcaggagggagccagataa

SEQ ID NO: 228 - DNA, 762 bp, Arthroderma gypseum
atgaagatcctctgtatccatggctcgtatggcagcgcatctgcctttcgcacccagctcgaaccctttctcgcccagatagagaagcctggggaggtggatttcaaattcatcgacggcctctatcctgccgtgcctccagatggctttcaggactactttggcccgccacctcacttcctcaacgttcaatacgacggtattgctggcttagagaacatgcaattgaacctgcgtacactcaaaccaggagaaagcttcgaagacacaataaagaggcttatcaaaaatgatgccacagtcgtgtctaaagaagaatatatgaagaccctcgactacattgagcagtgcctggtcgaggatccagaaattcagggaattcttggttactccgaaggtgctacgactgctgcaacatatttgttacagcaggcacaccggcaccgagacgaaggcatcccacacagggtcaagtttggcatcttcttcgggggctggccgcctgcaaagttcgaaggtgaccgccttgcgcccgtcctacccgaggacgatgatatgattgatatcccaacatgccacattgtcggctgtagcgacccctatctttacggcgccatgaccctgtttcaggtctgcgatgaagagacagccaccctattcgatcatggcaagggtcatttgctgcctcgagatcccatgaccattgccgagttatcagaatgcatcaacacaactctcaagcaggcaggtttccttaactag

SEQ ID NO: 229 - DNA, 879 bp, Setosphaeria turcica
atgtccaaccgccagaatatcgaattcaaaaccctcagcggcgtcacgctgcgcggatggctgtatccgagtgaaacgcaaaagaaaggaccgggcattattctgtcggctggtttcaacatgcccaaagacgtcgtcgtcccggacgtcgcagaatggttccagcggcacggcttcacggccctggtcttcgacacgtttggcattggcgagagtgaggggttgccgcggtgtgataccaacatgcaccgccgcgtcgaagacttcatcgactcgattacttttctcagtagccacccgctcgtcgacccccagcgcatcgtcctctggggcctctgtttcgacggcaacatcatgttggcggtctcggcgctcgacacgcgtgttgctgctgttctcgccatcgcgcccatgatcgacgtctcgggcgactcggagcggcacgccgcaatccgcgaactgggcgtcgcagatcgcgcagcacagctcgacggtgaaccgcccatgtacctcccgctggtcgacgaggacgggattatgccgctgggccagacatctggcctgggcttcttcactaccatgcagggcatgcagcttcccgttgagaatcgcgcgacggtccagagttacctgcggggcttatcctggagtatcgagcatttgctgccgaggattagtcccacgcccgtcttcatgctgacgccagagctggaccaggtgtttgctgcggagcgccagaccaaggcgtttgagatgctgggggaacccaaagaacagtttttggtcgagggaaaggatcatttcaattggatgtttggcgatgtggatgccgtgtttgggaggcagttgcggtttttgaagaggtttgtcgcggtttga

SEQ ID NO: 230 - DNA, 1062 bp, Setosphaeria turcica
atgaacgctcttgttggcgatgaagccggcggctaccgactcgcccataatattgagattccgtgcccaaaacccggcaccatgttgtgtcgtgtgcacgccgtagccgtcagtccgtacgacgccaagatctccgactactccaacatccccggggccattggcggctgcgactttgcaggcatcgtagtcgaagtcggcgacgacgtgaagcgcttcaaggcaggcgaccgcattctcgccgtcacatttggattgaatgcgctggacaagtcggctggtgctttcgcagagtacgcgcttgcgactgaagacctcgcctgccatgttccagatgacatgtcgctgtcccaagcaagctccgtgggtctcgctgttgcaacggctggtctggctcttttccaagcccctggattgcaactcagcatgccgcgtcgcgagacgccagagcaagaatcaccgccgtttgtcttggtttccggaggtgcaacagatactggtaccatggccatccagcttttgaaaatcgcgggctacacccccatcgtcacatgctcaccccgcaacaacacactatgcacatcctacggcgcggctgcctgtttcgactaccactctgcctcgtgcggcgccgacatccggtcccacacatccaacagcctgctgtacgtcttcgactgcgtcaccgataccgagacaatgcgcatgtgctactcggcgctggggtcctcgggcggcaagtacatcgccatcgaagcgctcgactgcgccatcaaatacacgcgccgcgacgtcgtcgccgactggctcatggcacccaccatcatgggttccccagtcctgatttcaggcacctacggtagacccagtacgcctgcgcaccgccgctttggagctgcgtttttcgccctcgtggagacgctgttgcgcgagggaaaactcaagggccatcccgtgcagatgagagatggcgggcttgcgaagatccctacgtatgtggataatgtgcgggtgaggggtgttcaggcccagaggcaggttgtgccgttggttgttgagtag

SEQ ID NO: 231 - DNA, 1278 bp, Setosphaeria turcica
atgggctccttagcacccgctccatccgtagccatcattggcgctggccttggaggactcacactcggtcttgtcttcaagcaacatggctacgacccaacattctatgaactgcgagaccctgattacgacttaggtggcgccatcatgctgcagcccaacgctctgtgcgtcctggatgctctcggtgtctattcccgcgtcaagtcccggggctttggcgcccaggtcatcacattcctggctgaccctgacctcgagtacacaggcgagtactggtttggacgcgaagacatctacgggtacgacgcgattcgtctttcacggcaggttttgatccgcgaactaagaagcctggtcaaagaagccggcatggaaattcactatgagcgcaagtttgaaaaggtggtgacggaagacgagtcgggcgtgtgtttccagttcgcagatggcacgcaggagaaagcagacctcttgattggcgcggacggtgtgcattccaaggtgcgcgcgtacatgtatccggatgtgcatcctacatactccggcgtctttggcatcacgtatgctttccccacggccaacctctctctgctgaccccggactttccgcttccggcctcgattcagcacaaactgggttccttcatcatggcgccgcagaacgacggaggacacgagatgtttgcagggcgacaatacaagtacccgaatcaggatcgagcgggctgggatgcattggcaaatgataaagagaagcttatggagatgattcagcgcagcacggaagaatggtctccactcgtccagtcggtacaagctcaagtcaggagcccagacacgcattccctgtccatctggcagttcgacagcgtccccaaaatggagcgctggtactcatccaccgggcgggtcatcatgctcggagacgccgcacacggcattccaccatccataggccagggcgccaaccaagcctttgaagacggatatagtcttggtttgatgctagcaaacgccgacggcaaagtcgcattgacagacgcactgaaggcgtggaacgactaccggcaaaagagaatggaaaaggtactcacgctgacgctgcaggtgctttcgatgcgaatgtccaacgaagagaaggcaaagattcctgaggagctgaggtgggacgacgatggaagcgaggggggcaagacaaagctctcgtggctgtatgtcaacgacgtgaagagcgatgttgaggcgctgctggaggagctgggtgtcgagcgctga

SEQ ID NO: 232 - DNA, 1695 bp, Setosphaeria turcica
atgtctacaactccgtcctacccaaatggcgacgaggaaaaacaagttgtagatatccatgaccaatccgtcagctcatcatctagcaccggccccgaatcagaaaaacctcgactcagcaaagacagcgcaggtgcggaagaaggcggagccacagagtcacaggatgccggcgagtacgcaactggagcgaagctcttgattatcgtccttgccctagtcctcagtgttttcctcttctctctcgaccagacgattgtcgcgaccgcgattccgaaaatcaccgatgattttcgcagcctcgatgacatatcgtggtacggctcagctttcttcatgacgctgggagggtttcagtccatgtggggtaaagcgtacaagtactttcccctcaagattagcttcctgttggccatttttgtctttgagctcggaagcttgatctgcggtgtggcaccgaattcgctgacgcttattgttggtcgcgcgattgctggtgttggtgccgcgggtatcgggtcgggagcgtatacgattgtagcctttgctgctgagccgaagaagagggcgacgtatacaggtatcctgggtgcggcgtatggtatcgctgctgtggctgggccgcttgttggaggcgtactgacggataaggcttcttggcgatggtgtttctacatcaacctcccaatcggcggtctagccgctgccaccatcttcatattcttccagacgcccaaagccgcgaagcccgtcgacgctcccctcggcgagaagctcctacagatggatcccatgggtacggttctcatcatgggcgccgtaatcgcgtacatcctcgctctccagtacggcggtgcaagggaatcatggaactcgggtatcgtcattggtcttctcgtcggcttcgctgttatcctcattgcctttggcgtcttggagatctggcaaggcgagcgctcgatgctcacaccgcgtctgatgcgcaaccgatacgtctgggtaaacggcttatttgggtttttcttctgcggcgcctactttgttccgctgtactacctgcccatttactttcagagcatcgacaacgtcagtcctacggcttcgggcgtacgcaatctgcccctcatcattgcgttcagcgtcggtgctgtgctttctggcggcgccatttccaaaaccggtgttgcgactccaatccttacagttagcgcggtcattacgacggttgccgcaggtgcaatgtacactcttgatattggcagtgggactggtaagtggattggatttcagatcctgtcgggattgggattcggagtaggtttccaggtccccatcatcgtggtacaagctactgcacagccaacggacctggcctctgtgactgcgattactttgtttttcgaaactgtcggcggcgcttttctcgtcgctgccgctcaatccggtttcgtcaaccagctcctgcacaaactcgcctctactgccgctggcgtaaacccagctctcgtcgtagctaccggtgccactgatctgcacagggttttctcaggtgatgagctgaatggtgttctggtcgcatacatggctggcatcaaggtcgcgttcgctattacggttggtgctgtcggcatctcagtcccgatcagcttgctgagcaagtgggggagaataaaccagcagaagcctagtgtgtga

SEQ ID NO: 233 - DNA, 1212 bp, Setosphaeria turcica
atgggagacgcatcacccgattccaactatctcattgagcagctcaatctgctggttcaaagtacagagactctaagccgaggagtcgacgaaacccaacgtctagagcttcagcgcctcactcgccttgcttcggtcgctttggaaacaccacccgagaccacggaacgcgtcatcttcgcatacctacctctggtcactgcacgcatcagcaacgactatggcatcctcgccaacttggtcaaaggcagcgaggtcaatccagtagctttgtccgaccttgttaagaccagtggtttggacagatctcttgttagctccatcatggactaccactgctacgagggctccgcgattgagcctcgccagggcttttatgcgcccacgaagctcacccgtaacatgacggatccatctttcgtccactcctcaaccaccttccacgacatggttggacccggttttggggctcttcaccgtcttctcaagaatgggcctgatcaaactggtcagaagacggccttccaagtcgggcaccacaccaccaacagcttctacgactgggtcgaatcccggccggaggtccacgaggcgttctacggctacatggctggcctgcactccatcatggcgcgttggatcaacgctgtggatttcgataaggactttgcgcgtaatgtcaaggtgaacgaggtggttttcgtcgatgtcggcggtggcgacggtggccagtgtcttgaggtgcagaaagcgcataagctgggcggaaagattattctgcaggaccgtgctgttgtcattgacaaggctaccaaggctaaggaggctgggatcgagtgcatggtgcacgacttcttcactgagcagccagtcaaagacgcccgtgtctattgcattcagttctgtctcctcaactggaacgatgaggactgtgtgcgtattctcgcggctcagactcctgccatgggacctgacagtgtattgctcatttcggactacgtgcaaggactacgatgggagaacgaaggtgggcctctagaggcggatttgttcacaccggccgtagccctctcttcgcacatttgccatggagctaagggaaggtcccgcgcagactaccgtgagcttttggagcgtgctgggttagagctaaaggaagtcaaggcgctgaccagtttcggtcaggcattgatcatcgctaagaaactgtag

SEQ ID NO: 234 - DNA, 8382 bp, Setosphaeria turcica
atgggtagctatccagagaccaacctcctctccatcccagagcccatcgccattgtaggaacctcatgtcggtttccaggtggtgcagactctccatctaaactatggagtctcctcaagaaccctcaagacattgtgcaagagattcctccgagtcgcttcgacacgaaagggttctacaacaaagacagccaacaccacggtagcttgaacgcacgacacgcatatcttttgcaagatgatccccgagcattcgaccgcgacttcttcaacatcagccccaaggaagccgaggccatggatccccaacaacgctgtctcctcgagacagtctatgaaggcgttgaatcggccggatactcgataccccagctgcaaggctccgcgacaggtgtctttgtaggcgccatgagcttcgactaccaatttgttgctatgcgaggcttcgatagcttgccacagtaccacgcaaccggtacttccatgtcgatcctggcgaatcgcctctcctacttctttgactggagagctgttcttgcgctgcggaacggtgatgttagtatggctgttgctgccggcgctaatcttattctcgggcctgagccgtttatcgccctgtcaaacctgacgaaggaattgaagttaaacatgctgtcacccaacggccgttcatacatgtgggattcatccggcgacggctacacacgaggcgaaggcttcgctgccgttattctcaagactcttagtcaagccctagccgacggtgaccacattgaatgtatcatccgtgagactggcgtaaactcggatgggcggactccgggcatcaccatgccgagcgcaacagcgcaggctcggcttatccgagagacataccaaaggtgtgggctagacataaacagtccacttgatcgcccacagtactttgaggcccatggtaccggcacaccggcaggagatcctatcgaggcccgagctatacatgaagctttcttttctcatagtccggaaccccatgacgaccaggcaccactctacgtcggctccatcaagactgttcttggccacactgaaggcactgccggcctcgctggagtccttaaggcatctctggcagttcagaacggttcaattccaggaaatctccattttaaaaacctgaatcccaagatctggcctttctacgacaaactgcgcgtccccaccacattaacgtcatggcctagccttccagacggccagcctcaccgcgtcagcgtcaacagctttggctttggaggaaccaacgcgcacgccattatcgaaagctgggatgagaagcccgagcggtgtcctttgagaactgcagaacatggcggacttgttgtgttatctgccaattccgcacaggcattggcagcaaaggctacgtcgctggctgcataccttcgaaagcaccctgatacagatatcgaccggctctcacgcaccatgttccagcgcgctgatttcctataccgagccgcctttgcagccacgtcgactgcccaacttgcagagaaacttgaagcacgaactgagatgttgaaaaagacttcccgcattgcggcaattcctaaccacttgccgccccgcatccttggtgtctttaccgggcaaggcgcgcagtgggctactatgggcagggaactgtacgatgcatcgcctgtgttccgcaaatccatggaccggctgcagcgaagccttgacacgcttcctcatggcgaacgcccagactggactcttatcgacgagctttcgctgtccaaagagacgtctcgtattggtcaagccgccatctcgcagccactgtgtactgctttgcagatcgctctcatcgatgtcttgcacgtcatcggcatctcctttgctgccgttgttggccactcttctggagagattgcctgtgcctatgcagcagggtacctagatgcacaggacgccatccgcgttgcttattaccggggattccactcacacctctccaagggccccgacgagaaacgcggcaaaatgatggctgtgggactgagtctcgagcaagcgtcagccttctgtagtgagttcgggtctgcgctcaaagtggctgctagcaactctcccaccagttgcacactggccggcgatgcggacgccattgatgaagccaaagagcggctagagcaggaaaagacttttgctcgtgtgctagctgtagacaccgcataccattctcatcacatgcttccctgcgccgaaccctatctacagtcgctacgcaactgtggagtccgagctctcaggggtccaaagcgatgtgcttggtactccagtgtctggggccccaatggacgcagccgctctttcgatagcaaagatagcatggagttgctcgaaggccagtactgggtcgataacctaaccaacacggtccagttctcgcaagcagtataccgagctatttccgaagagcccttcatcatggacctcgcactggaagttggaccccaccctgctctcaagggacccagctctgaagtcatgaagtcgctgactggggtttccgttccatatagcggtattttgaaacgcggagagaatgccgtcgaagcgtttgccgatgctctaggactcatctggacgtctttcccatctcagaaccctatcgtcacgttcgatgggatgcatcgcgccttgccacaagctggaccaaagaagcctagcatcctgaagaacttgccaggttacccatgggaccatgatagcctcatctggcgtgaatcgagggcttctcgcgtgttccgctctcagaaccagccaagacacgagctcctcggtcaccctgtaacgttgggcgaacatagcaggcgagaggtacactggcgccagatcttcaagctgggcgagcttccttgggtgactggtcataatatccaaggcgaagtacttttcccagccacggggtacctcacaatggcgtacgaagccgctatacgccttgtagacaatgagacagcgctgcgcctcgtcgagttgcacgatgtggagattgttcgcgctatgggtttgccagaagattcccccggcctcgaggttctcttcactgtgtccgttacaggccagtctgacgactgcgtcacggcaaaagtggcttgctacagcggcaacgtcaacgtagccaagctggatagtcctcttcatggactcacagctcatttctcagctggcgttagactttggctcggtgaacccagcaatagttccctacctggccgcaacagacccctgctccccatgaataccctcgatatggagcagttctactcctacctgtcgaaggtaggatacaactacgcgctgcctttcagagcaaccagtgtggaccgccatctcaaccacgcggtcgtgacgcttccatcgcctccagagacgtcttcgtctattcgtgatgttacgcatcccgtagtcctcgacactgcgattcaaggagtcttggccgcattttctttccctgaagacggccgcctggacactgtgtatctccccacacgcatcgactgcgtccgcatcaacacatcgtcaacatataatagccccttgatggcagacagcgtcttgacatcgaccgaagcaaaggcactcaagggcgacatcgaggtgttcagcgagagcgacgcagccgtccacgtgcaaatgcgtggcgtccactacactgcgctgaaccaaaacaaagaccgatggctgtacgcaagcgagaactgggtgcgcgatgcaatccacggtattgagccgagccagatgaccaagctttctcctgaagccgaggcgtttgagaagctcctgacacgcatagcgtatttctatctgcgcaagctccgcgatcagatcaagccgtcggagctattgctcatgagcaagcaccgacgccacatgatgaagtgggtcagagagcatctgtttccccagatcgaggcaggccagcgtccagatgtcgaagtggaatgggtaaacgacaccctggaggatgtcgagcggtggagcgctagttaccttgcagctggcaacaacgacatgcaactgcttcatgccgtcgggaagaatctgcctgctattgcccgcggaacgaagcctgcgctacaggtgttgctgaccgacgacatgctggaccgtctgtacgtcgaaggcactggaatcgcggatgctaacctcgactttgccctgttggtgcagcagattgcacaccgctacccgcgcatgaatgtcatcgaggtgggtgccggaacaggcggtaccacgcgagcggtgctgtcctctttgggcgatcagtatgcgtcgtacacttataccgacatctcagccggatttttcgagcctgcaaaggcaaaattcagccagcacggcggaaagctcaagttcaaaacactcaacattgaaaaggaccccatgggccaaggctttgatgaaggctcgtttgacatggttattgcttcaaattgtctccacgctactcgcagtctccaggaaacactgcgccactgccgccgcttgctccggcccggaggctacttagtcctgctggaaatcactcgcgaccatctccctattgaggagtgggacgcgttgctcaaggcaaacaggttctctggagtaactgcaagctcgacgccttcttattgctctgtgataatgtcgcaggcagttgatgataccttccagctactccaggggccgctctctgtcacttctcagcagcagccgttggcatccagaggaccggtattggttgttggtggtaacaagtcaggacttggtgccaggtctcaggaaatacttgcttctcacggtgcatcatacctgcatgagcttgagggcatcgaggtgccgagtggagcagtcgttctctgtctatctgacttggacaaccccatctttagtgtcatgacagaggctgcgttccagggtatacaaacaatcttccggaacgcaagcattgttctgtgggtgacgtctggagcggcttcgggcaaaaatccaatggcgaacgtaacggtcggattaggacgaacactgcttgccgaatgcagtgacttgagactccagttccttgacgcggaagagcctgattcactcactccggaattgctggcgactcttctccttcgacttggcgcaacggaccagtccaactccgatgatatcctctggaatcatgagcctcatcttgcactgagagacggcgcgttctacgtacccagagtgctgcgcctagacagcttgaaccgccgcgctagtgcgaagaaccgaaagctcacccagagtaccagtcttgagctctctgatactggcgtcgagatgtctcaacaagacggagccttggagctgttcgattaccctgtcggcgattgtaggccaagcgagattcgtgtacaggtcatggcatcatccatccatgcttttacactcgatcgcccggcgcccgtttacttctggattggtcacgatgtccattctaaagacagagtcatgggcttttcggaattcaaccgctccataatcacggctacggaagatcagatcttttaccgtggagacaatgtcagcacacaagacaagcgggattcagatgctgagcagctgcaccgattcatcgtacaagcgatggctgcatctcttctcggtaattttgaggcacccatctgggtacacggcgctccaaaccacttcaagccggccattactcgtgctgcccacgaagccaatgtctcagtgtccctgacgacatcagatattgcaagcgctcaagacgagggtttcatccacccgtacatcagcaagcgagatcttcagtcacttgtcccaagatgcgtcaaaacactgatcaacctggaggccgcgcaaaacgaggatctctcgaagctaatgcgagattccctgccttcttctaccaaggtaatccagggtgatgatctgacgattccgatcaggtgcgagaagctgcgcgagctagcccaggttattggtcatgacgaaatcaagggcgcaagtcacgcagaccatgtcacatccattggagagctgacagaagacaaagtcaaagcattgagccaaggggctgtcatagactggcgcactaccgatagcgtcaccacgactgttcgacctctggatcaaagcgggctcttcgatgccaacaagacctacatccttttcggcatgacaggggacgtcggcatatctgttgctgcatggatggttgaccacggcgctcgaaacgtagtgctgggtagccgaaaccctagggtaccagagggcgtcattgaatacatggctcgaaaaggagccaacctgtgcgcagtcaaggtcgacgtgaccaagaaggaagagctgcgagaagcgtgtgccaacatcaaggcaaccatgccgccgattgcgggtgtcatcaatggcgccatggttctccgagaccgtcttttcgcccacatgtcctgggacgactttgaagctgtcctggcgccaaaggtcgctggaactcagaacctggacgagattttcagcaacgaacaagatgcgctggatttcttcattgttctttcgtcggcaacatcgctggtaggcatcataggccagtctgcctacagcgcagcgaaccattttatgtcgagtctggtgcgccagcgacatgctcgtggtctagctggttccgttgtggcaatcgggttcctgacgggcttgggctacattttccgctcggaaaaggagcatctcgatgctattgagagacaagccgagacagacctgcacgacatgctcgcggaggcggttgtgtgcggtcgacccaactctggtcagccgtctgagctcatcaccgccatcaagacaacattcccggatgcgtggcacgaagacccacgcctctcatgctaccttgtacaggatagcgtggaagaaggcactgatgccaaagaagtcgagggcaatgccaaggtcgaagctcaattggcatcggccgaggatccaaagcagtgcttgacgattctgataaagtgcttcagcgtggcgctgggcaacatgctccagctcgacccggctcagatagcagtcgacgtccctgttgtcgatcacggcgttgactctctggtctcggtccgtatccgcgaatggttcctcaaagagctcggcgtcgacgtgccggtactaaagctcatgtcgaccaaccactccctgtcgcgcgtatgcgaggatgcactagcaggatggcggaagcttcgtgcagggcccccaacagcgtcccagacagaggccaaggacaacgagcctcgccgcgacccagaaaaggactggaaaaaggaggtggccgagctcattagcggaatccgaggcctcatcccgcgaggcactgatgcaatggcgagcaccgagccgcctcggacaaacgctcgccgggtcgttgttacaggatgtacagggttcctgggcactcacctgctgcgccatctggtcgccgatgcgagtgtcgctgaggtacattgtctgtgtatccgctcacgccatgtacgcgtccaggacgccaaaatccgtgaatacgccggcgacctagccaagccgctgttgggactctctgctaccgacttcaagcgcctcagtcagacagcagacgtgatcatccacctgggtgccgatgtcaaccatctcaagtcgtacgaggcgatgcgtgctgccaatgtggtctcgacacagacactgcttgccatggcgatgccgcgcagcgtccccgtgcactacatctcatcctcgtcggtggccatgctgcagaagggaacttcggaactcgcagaagtggcgccctcgagcatctcaccgccacgtgacgtcgattcgttgatgaagagcgccgtgggttacgccgccagcaaatgggtgggtgggatgctgcttgaaaacgtcgagggccctccaacggtggtgcatcgctttcccaacatcatgggccatgatgcccctgaagagattcccttggtagctctcgatcgctactgcaccaagatgcgggccgtaccagcgctggatccccgcttgtggatcggccagctcgatgtcatcgatgttggccaggttgtcccggactttgtggaaatggcgtggagcctggattcccgtgaatcattcgccgtacacaactactgcagcaataacagttacttgctttcggatcttgcgggaatgtacagagagagactcggggccaatgttgaggttctgccgacgcctgagtggatgcgcagggccatcgcgatgggtatgcccaagggtgttgaagccacatttgtgggccatgacgaagtgtttgtgtcgcctgttttgcgcaagggtccggccaagaaatag

SEQ ID NO: 235 - DNA, 915 bp, Setosphaeria turcica
atggcggagaacagaaaagaattcgagttcaagactattgatggcctgactctacgtggatgcatgtttctcggtcccaagggcggtcctgctatcattgtcaacggtgccttcaactgccccaaggaaatattcgcacttgatgttgcagaatggtttggaaagcatggcgtaacggctctggcctatgacgctcgtactctaggtctgagcgatggcatgcctcgaaacgatctcgacccacagaagatggcagaagacaaccatgatgctgtcacgttcctacaaaacgagggctgggtcgacccaacccgcatcgccgtatggggattcttctacagctccggcatagctctcgaagccgccgcattcgacaagcgcattgccgccgtcatcgcccaaggcctaatgccaaactggtgtctcaaccccgccgaccaagaagccattgtcgctctcgcaatcgcggatcgcgcaaaccagcttcggggcagcgcccctgactacattccattgttgaaccagaacggcgagcacctcctcatgttcaagtacctggttgatctcaccgatgagcagaaagcacatctccccgcgtgggtccacaacgcgaagaaactggcgccaaacttcaaggaccgcatgacggtccagagcttctatcgccatgcaaagtggaagccaatgcacatttttgaatctgttagtcctactccggtcatgattttgacccccgagaaggatgagattgtggcgccggagctgcagcggaagatctttgaaagtatgaattcgaagctgaagaggcatgagattgtcaaggggaaagggcatgcagactttttggctaatgttagtcttgataaggtgttgggagggcagttggagttcttgaaggaggtttttgttttttaa

SEQ ID NO: 236 - DNA, 909 bp, Coniothyrium sporulosum
atgggcttgagtgaacaggatgttgaattcaaaaccttggatggaactgttcttagaggtacactatatcctacaagtaatagaggtcccgccatagttatgtcgccaggattcaattgcgtcaaggaaatgcttggcctgcctgatgctgcagctcgttttcaatcggcaggctacaccgtgcttctttacgatccaagaaccacgggtctttcaggcggcgagcctagaaatgacatcgacccaatcgcgcaggtcggcgactactctgacgccatcagctacatcagcacgctttcctctgtgaatccttcagaggtctttatatggggcatgtccttctcggcggcggtgggcctttgtgttgccgcccttgacccaagagccaagggtatcatcgcagtgtgcccattgacagacttcacatacacggaggaaaagcttcccatggtgctgaaaaagtgcgcccaggacagagctagccaggtcgccggaaacgatccattttatttgcccatgctggacgctcagggcagaaaccctgcgggctttggcgtcggcgtggatagcgagcaatactcgaagattgtcgaggctggaaaagagatcgcccccagacatgtgaacagaacgactgtgcagacctactatagaatggttttgtggcagccattcggtttgtggaggatgatcaaaaatcttccagtgttattcgttgtgccagagctggacagattgagccctgcagaaagacaattgggtcattgggactccttagtctgcccaaaaagaaaggtcttggtgccaggcgtgggacatatggagataatggaaggcgaccacgtggatgagataatgactgacatggagaaattcctgagagatgtcttggagggttcagtaccatag

SEQ ID NO: 237 - DNA, 1584 bp, Coniothyrium sporulosum
atgttggccaagcagatcctttccaacttgcacttgagtgaagcgttgtattcagtggtgctagtgctgctagccggtacctgcgtcttgtatacggcggttctagcgatctacagattgtactttagcccactggctccttttcctggacctaagttggcagctgtcaccgcgtggtacgagacatactttgagttggtgaagaatggaggtggtcatttcacattcgagatcatgagaatgcatgagaagtacggacccatcgtgagaatcagcccaaaagagcttcatattgccgacagtgaattctatgatacgatttacacatcaacgcaaggcttcgacaaatctgcacacgttcaggatagattcggagcgccagaggccgcgttttcaactcctgatcatgaagtccacaagagacgtcgtgctgctatctccccattctttgctaaaagacgtatccatgagcaagcgcccatgatccaaggccacgtcaacaagatcgtcagaagacttcatcacgaatatgctggaaaaggaaagattttgaatttgaatgacctttattcgagctatgtgtcagatgtaataatgagctacgcattcaatcgttcgtacggttttttggacgagccagactttgtctcgtctttcacatcatccattcaaggattgaaagacttcgtacattacgcgcagcagcttccctggttgccaaagatcattgacagattgcctgacagacttgtcggctacatccaacccagcatgaaagccatcctacacttccaaaactcgatgaggaatcaggtgaaggaggtgagagaaaacttgcactctgacaaggccgaagcccaggaaggtaccatcttcttcagcatcatcagatccgaactaccacccgaagatttgacgatcccccgtttgaaggatgaggcgatgagcgttgtcggcgccggcatcgagacgaccaagatggctttggcagttctgtgctttcacatcatcaacacccccagcgtgttggaacgtctgcagaatgagctacaagatgccattcccgatccatcaaaccccccaccactgtctgttttggagaaactgccatatctatatgcgtgtctgcaggagggcattcgtctgtcttacggtgcgatagcacgttcgcaaagaatttcaaggcacaaccccatcaagtacaacgattgggttatcccacctggtgttatggtgtcgctagatacataccacatgcaccacgacgaggccgtcttcccacaaagtcacgaatacaggccagagagatggcttggtaatcccagaggccccgacggcgagaaggctcttacaaagtatttgactgcgtttggaagaggtacaaggatgtgtgtgggattcaacctggcctatgctgagatgacgcttgtacttgcggcactgttcagaagcttcacctttgagttgtttgagacggacaaaggtgacgtggagatttttagggatatgataggcttggaggttaagccaggtagtaagggtgtcagggtcaaagtgagtggtaaaggtgaagttcagccttaa

SEQ ID NO: 238 - DNA, 7152 bp, Coniothyrium sporulosum
atggcggtacacgactcttctttgggtgttttcagacacgagccactggctgtcgtaggttttgcttgcagacttcctggtaaaagcaacaacccaaccgccctatggaagttcctggagagaggtggcatcgcagatatcgagccccctctatcgaggttcaatttgaaaggtcacgaggatggctcaaaaagaccaaaaactatgagatcacccggcggtatgttcatcgaggacatccatcccacagaccttgatgctcagttctttggtctgtccaaggcggaagccatcgcaatggatccacagcaaagacaactgttggaggtcgtgtacgagggtctggaaaattccggcatcacgttggagatgctgaagggtacatcggcaggatgcttcgttggttcttttgcttgcgactatggagatatccagtcgagagatcctgaagaccgtgcacctaacaccactgttggcatcggtagagccatgttgagcaatagattgagtcattttcttgacatcaagggcccaagcatgacgatagataccgcttgctcgggtagcctgcagagtcttgatgtagcgtcaagatacctgcagacgagagagatcagcaccgccattgttgcgggtgcgaacctgtatctaagcccagagcattgcatcgatcttagtggtctgagtggtgctgcgtccttaacaggaagatgtcatacattcgatgccaaagccgacggctacgtgaaggcagaggcggtcaatgtgctgattgtcaaacgtttggctgatgcattgttgagcaaagaccccatcagagccatcatacgtggcactgcttcgaacagtgatggctggactgctggaattgctagtcccagctcaaaagcccaggccgaggtcacaagacaagcctacgtcaacgcaggtatcaccgagtataatgcaacctcttatctagagtgccatggaacaggtacaaagacgggtgatcccgttgaggttaaaggtgttgcttccatcttttgtgctgatggtacgaggaaggatcctctatacattggatcgataaaaagcaacataggacactctgagccagcgtccggcatatccggtgtcatcaagacgatcctgtctatggagaaaggtgtagtacctggcaaccccacgtttgaaaccccaaacccagacattgactttgagaagttgagagtgtccgtttcgagaaaatctagaccatggcccaaagtccccttcaaaagagccagcgtgaactcgtttggtttcggcggctcgaatgcgcacgtcatcttggacgaggcaaagacgggcgccgctggttcccaaatgagattcaagtcgtcctttggccatgtagacgactttgacttttttgcagaagagaaactggagccaccacaagtcctggtgttctctgccaacgacgtcgcctcgttgcagagctacgccgattctctaaacaagcatttgttgaaccctgcagtcagcgtggagttgaccgacctggcgcatacgttatccgagagaaggacgaagcatttcaatagagcatatctaattgcaagaaacgcccagatcgacgtgcacagcctgaagttgggaaagccaagatcttctcaacctagaatcggattgatctttacaggccaaggtgcacaatggccacaaatgggtaaatcgttcttggaaacgattccagcctgcagggccgtggtggaaaggttggaccgtgtgttgcagacgctgaagaacccaccaacctggaccttggtcgacgagctgacgcagccaagaacaaaacagcatttgcagcagcccgagtactcccagcctttggtcacagctctacaactagcgatcttggaagtcctgagatcatggggcgtacagcctgtaagtgctacaggtcattcgtctggcgagattgcagccgcggttgctgctggtttgctgacgtccgaagatgctatcaaggtagcgtacttcagaggaagagcagcagccgacgtgcacgatgcgtccaaagctaaacacggcatgcttgctgtcggattgggcgagcatgacgtgagagacatgttgagagccgaggagctgcccattgccatcgcatgtgtcaattcgccaagcagcgtcacactttctggacaggtggttgccctaacagctttggagcagaggttcaaggagcaaggcaagtttgctagactactacaagtcgatgttgcctaccactcaaaatacgtcgcagacattgccgctaggtactacgagctgatgagacaagagtgcgacttccctttggcagacgcgacatattgcaagatgttctcatccgtgacgggatccgagaacaatcaggcttgcaatgcagaatactggagaagaaacatggagtcgcctgtgctgtttagccaggctgtctctgcggccttgacggaagacgcggctgccgacttcatcatcgaagtcggacccagtggcgccctggccggcccattcaagcagatcaaagcatctttgggcagcggagcggcacatgtgtcgtaccacgcggccagcagaagagatgttgctgctgtcgatgcgatttttgaaatcgctggggaactgttcttggcgggagcacaggtcgatctggccagagtcaaccaataccttccaaaccagcaacccccttccactttgatcgaccttcccaactactcgtggaaccactcggtcagattgtggtacgagagcgaagccagcaaagactggagattcagaagatacccaagccatgatttgctgggaagcaaagtcttgggtacttcgtggcacgcaccttcgtggaagaaagtcctgaaaatcgatgaggtcagctggctgaaagatcactgcatcggcggacaggtgctgttccccgccgccggatatgtggccatggcgatcgaggcgcagttccagacgagccagtctagaggcttcatcgaggaaggtagatctgtccacgaggcaagttacagactgagaaacgtcgcattcaaaaaagccatggtcattgagggctccgagtcgagaatcatgctgacgttgagtccagaagacgacggcgaaaagtcctggagcagattcacaatttcttccttcaccgacgaggagtggaacgagcactgcacaggtttggttgctctgaccgtcggatcccagcaagtcgcttcacaacatgatgtgagagcgttggagtttcccacccctgcagcggcgtggtacaaggctatgagagacgtgggttacaattttggtgagttgttccaaccacagatcagcatcgaggccgttgctggaagcagacaaagcagggcacacatctcgttcaaagagccaaaatcctcgtacccacagtctccatactctgtgcaccccgtctcaatcgacggctgtctacaggcgggtgcgccatcactgtggaaaggtattagaagtgcggtcggcggtgcgcttgtaccagcaatgatagacgacatgtcgatcaattctagaggtcacatcgtcgaggttggcattgcgaccacgtctgccgtcttcacgggtgtaggaagctccgaggaagcacaaaactacagatccaacatcacagtctacgaccacgagacgcatttgccactggtccagatcaagggcttgagataccataaattggacgcccacgatgactctgccgatacgcattccttcatgagagtagcttggaagcccgatattgcctacatggagggagaggctttgcagagatactttagatctggcgatggtaagccaaagtcagtcctagagctattgatccatagagatcccgctgtcgacgttctagaagtcaacatgtcgagtgacatggagagcatgtggatcagcaacaaggcttcattggaagccagcggtgcctgcggacagtatactctagtgactccagacccagcctccttgttcaccttgcagagcgagttcagagaagttcccggtgttagagtcgtgcatgccaatatcaccgacgctgcgttcgatttctcgtcgttgcctacaaattacggtcttgtgatcgtgagagcatcaaatgacgacagcgcggagctgcagaccgccctggtgaacatccaaagcttgcttggtgaagacggctttcttcttgtgcactattcggcctcgttagccttggataccgagactagcaccgacagcggtgcctccggctctcacttccaggtgctaggcccagaacatgaggtcgttgagaagatcctgcaggacgcgggatacagatctattagaaatgtacctcagatcgtgccatcgtcagacgcctatatttccgagctgatcgcgcagcctagcgccagggaggcacttgccaacggtgtttcgcattcagtggacttgctgcgtctttctaatattgcgcatgacatgtcggaaatcgagcactctgtcacagacaacggcttcaccgttagacagttggatgtcgagcacttgggcgagatcaagtccggttccacggtgttgattgtcgacgaagcgtacaaatcagtgttgtgcgacgtggaccagaagcagtggcatgctatacgtacgcttacggagagggactgcaggatcttgtggatcacagctggtgcacagctgcaagtgactaacccccaaggtgcgttgatcaacggcatggctcgtgtcatcagagcggagaacccatcagctgctttgaccatcctggatgtcgaagacgtgtcgaacgcatgtgccagagaagccatcaacaagctgctgtacgatgtcaacaacggttcggtcatggaagcggagtatgtcgagagatctggtgtcatccacaccagcagagtccttttggatggccccgtcaacgtcgcacagagagaggattctcaaggcggcgagttccagaccaagcatttgcacgagcacccttcctgtgtcagaatggtttgcgaacgcccgggcatcttggagtcgctgaactttgtagaagtggcagagggcgacttgcccttggaggatgactttgtcgaaatcgacatgcacgcggcaggcctgaattacaaggacgttgccacgtcccttggcttggtcccagagaaccaatacatgttgggattggaaggcgccggtgtgatcagaagacttggagcgggcaagaaagcgcaaaagtttagaatcggtcaaagagtcgtgctaatcagaagaggcagctttggcaacaaggtccaatgccctgttgagggcgtgcatgctatcccagaatggatgacctttgaagaagccgcgacactgccagtggtttacttggccgtcatctatggtcttttcaacttggccaacatccagaaaggctccactgtactgatccactcagcagctggaggcgtcggcattgctgctatggaggtctgtagatacgtgggtgcagagatcttcgccacggtcggcagtgaagagaagcgtgtgcatctgatggagaagtatggtttgagtaacgatcgtatcttttcgtcgagaaacagcgagttcgcagaggaaatcatgagaataaccaatgacagaggcgtggacattgtgttgaactcactgaccggtgatttgcttgatgcctcctggagaatcattgccgactgcggaaccatggtcgagattggaaaaaaggacatccttgcgagaaaaggattggccatggatcccttcaacagaaacgcatcgttcagggccgtggatatgtcggccgacagcattaccagacccgtcatcgcggctctgctgtcgcagctgttcgagatgctgaatggaagacacgttagacccatcgagcctagaaccgtcttcccctactcgaagattggcgatgccatcagatacatgagaggcggcactcacatgggcaagattatcatatcgagagaggccgagaacagcacgcctttggtgccaatcagacccgcaaagagagtcgtgcatttcagggacgacaggtcgtacttgattgtaggcggattgaagggtttgtgcggcagtctggcggtgtaccttgctaggaatggtgccaagcacatcgccatcatggcaagaagcggctacgaagacgaaagatcgcaagcggtgctgttggatctgcatgcattgggcgcatcaccaacgttgatcacgggtgatgtgtcgaagatggaagacgtgaaaaagtgctttcagagcgcttcgccacctataggaggaatcatccaaggcgcgatggtcttgagagacaagacgtacgaggagatgagagtcgacgagttccacgcggccaccgcgtgcaaggtccaaggcacatggaatttgcacacagctgcacaggacttgaacttggacttgagcttcttcaccatgctgtcgtccatctcgggcttggtcggtcagaaaggtcaagccaactatgccgcagccaacacgttcttggatgccttggccgcctacagacacggccgtggcctgcccgcgtcctcggtcgacctgggcgtcatcgaggacgtgggctacatctcggagagagccgccgtggccgcgagattgaacacggccatctggaagcccatcaacgaggcgctgctgcacagaatcgtcagagcctcgcttctgcagcagtcgtctcgcccgctgcacgtcgccagcgccccacacatggtcacgggtatcccacacccacagcctgttgatgcaccattggtcgcggacccaagattcagaggcctgagacagactgcggcggcaggcacccacgcagcggccggcgacgcgagctccgaagtgagaagcctgttggcgttggctgcgtcgccagccgtggacaagcacgcgctgctggcggcggcggtgggcgtgatcaacggtcatttcatgaagagtctgggtctgggtgagccaatggaacccgcgaagccactgacggtgtatggtctggacagtttggcggcgatggagtttaggaactggctgagaaaggagctgcaagtgagcgtgacgacgctggagattgtgggtgccaagacgctgaatgcgattggtgagaaggtgtgtgagaagctgggtgagggcggcaagcagtaa

SEQ ID NO: 239 - DNA, 999 bp, Coniothyrium sporulosum
atggacacgttgaagagattgtggcctcagttgcggcccagccccagagccccattgaccgaggccaacctgccatcgcaagcgggcagagtcgtgttggtcacgggcgccaccgccggcgtcggatacgagctgtcgagaatcttgtacaacgcgggcgccagagtctacatggccgcgagatcgcccgccaaagccgaccaggccatggccagaatcagaagcgcccaccccgcgcccaaggtgcccggcggcgccctggtcttcttgcacttggactacgccgacctggccaccgtcaagccatgcgcgttggcgttcctgtccaaggagccaagactgcacgtcctgttcaacaatgccggcatggcctccgccccacccgaagcgagatcgagcgccggcttggagctgcacatgcaggtcaactgcgtgggcggctttttgctgaccaagttgttgacgcctgcgttggaggctgctgccaaagacgacgacgcacccccagccgccgtgagagtcgtcttcagcagcagcatgttggtcgacgccaaggcccccgccgacggcgtcccacccgacgagttggacaacccctcgttggacggcgacagaaactacgccatcagcaaggccgccaactggttcttggccgtgcagttcgcccagagattgggtccccagggcgtcgtggtcttgacccagaacccaggcaacctgagaaccgccatcttcgacgaggtgcccaaggccattgtctgggcgagctacccagtgctgttcaagtcgattgacggcgcccacacgtcgctgtggtcgggcttctcgagcgacgtcaccctggcagatagcggcagatacgtcgtgccctggggcaagtggcatccaaaccaccgtccagagcagctgttggccatcaaggacaaaagcgagggcggcaagggctacgcccaacatctatttgagtggtgcgacgcgaagaccaaggcgttccagtag

SEQ ID NO: 240 - DNA, 1716 bp, Coniothyrium sporulosum
atgcaacctgcttcattgttgcttgccctggctgctgccgctgctgcgtcgccaacctacggctcgttccccgtcagaggacagacgtgtagaaagttgccccaggacaaggactggccatcgccacagatctggaacgtcctgaacgcgaccgtgggaggacgtctgattgccacaacacccctagcatctccctgccacgaccccaactatgatgccgcaaagtgtgacgctttgagagcgggctgggtgtacccacagacgcatttcgattcctccacctccattgttgctccatacttccagaatcagagctgcgacccatttacgtctagagcaagcacttgcaaggttggaacgtaccccagctacgccatcaaggtcaccaaggcctcggatgccatagcaggcatgcttttcgcacaattgaacaatgtgcgtctggtcatcaagaacaccggtcacgacttgttgggccgttctactggtaccggaggtctttcgctgtggacgcactacttgaaggacatcaccatcagtgattacaagtcgtcttcttacaccggcaaggctatgaagatgggtgctggtgtccaagcctacgaagcctacgaggccgctcacaagcagagcctgagagttgtgggtggtacttgcccaactgttggtttggccggtggctacacccagggtggtggccactcgatgctttctaccgtccacggtcttggagctgaccaggtcctggaatgggaggttgtcaccgccaacggcagcctgttgaccgccacccccgacaagaacagcgatctgtactgggccctgtccggtggcggcggcggtacctacggccttgtcttgagcatgacggtcaaggcacacgccgacaccaaggtcaccggcgccatgttgaccatcatccaacagggcgccgaggacgccttctggaagggcatcacgttgttccacgcctccatgacctcgtacacggacgccggcgcggcctttggctattacttgggccagggcatcatggccatccaacccgtcaccttcccaggcaagtccaaggccgaggtcgaggcgttgatgttggacctgaccaagaggttggatgccgccggtactgtgtactcgttgaccgtcaccgagttcagcaactactacgacttcttcaacaactactacggcccacttccctacggcgtctacacctcggcccaggtccagggtggacgtctggtcccaagaacagtcgtcgccaccgccgcctccaaccaggccttcaccgacgccttgaaggccatcgtccaggaccaggacttccacgtcgtcggcgtcggcttggacgtcagcaagacagcaaccgcttccaacgccgtgcaccccaagtggagatcgaccgccatcaccatcgtcgtcgccgccaactgggactacacgcagccatttgcgaccaacgccgccaacgaaaccttgatcaccgacaagtacgacccattgttgacggccgtcacgggcgccgacagcggcgcctacgtcaacgagggcgacttccagcagcccgcgttccaggacaactttttcggtgcaaactacgccaagctgagatccatcaagaagaagtacgaccccaacagcttgttctacgcgaccaagctggtgggctcggaagactgggctgtgcaggctgatggcaggctttgcaaggcctga

SEQ ID NO: 241 - DNA, 1011 bp, Pyrenophora teres
atgtcgatgacatcaggcaacaccaaggataagggcggctacagacaaatcaacaagtccctcaacatctgcgcctttgaagattacctcaacggccaaacagcagggttgaagcctatcccagatgtcgaacaagtcacaccaagagtgatgcgtgtacgaggacagaaccccggcaagttcacaatgcaaggcacaaacacgttcctagtcggcactggcgcttctcgcatcctcatcgacacctcaggcggcgagccagaatacgcaaagctactcgcatccactctggaattcctaaacatcagcatcaaatacgtcctcctcacacactggcacggcgaccacacgggcggagtcccagacctactccgcctctacccccacctagaaaaccacatctacaagaacataccagaggtcggccaccgcgacatctcagacggtcaactgttccacgtcgagggcgcaacactcgtggctgtacacacaccgggccacgccgaagatcacatgtgctttgtgctcaaggaagaaaactcaatgttcactggtgacaacatcctcggtacgggtaccagcgcagtcgaggacttgggtatcttcatgtccagtctgcaaaagatgttgggaaagaactgccaaaccggacaccccgcccacggccaaaccatcggtgacctaaacgcaaagatatcaaaggaactcatgtcaaagttccgacgagagaagcaggtactgcaggccatgcgcgacctacgggatgctgatgagaggcggccaaacgttcgaatgattgtcgatcgcatgtatggaagctccgtcaacgagactacgcggacattggccttggagccgtttattggcgaggtactgcggaaacttgctggtgatggcaaggttgggtttggcgtgcgggctgggaggaagggctggttcctggttccaaatgagcagcagagtacgcagttacggcatacacattcggtttttgtaagagctagtgcatag

SEQ ID NO: 242 - DNA, 5358 bp, Pyrenophora teres
atgaacgccatctatttcagcaacgaattccccaaggaggatttgaaggatgtcttccgacagctgcacaaggagagcaagagcagcatccaccatctgctcgcacgctttatgagtgaggccacgagggctgtgaagaaggagattgagcagctaccgtccagcctgaagcagataatacctccttttgagactctcagtgcttgggcggagcagaaggaactccgcgaaggtgaactgtgtggcgctatcgatggcgttttactagttctacttcagatatcagtatacatatgccatgctgaggccggtgcagagctcccaactgctccgcacctatctgcgcttggaattggtctcctcggagccgccgctgtttccatgtccaagcagatctctgacctgccctcctacggtgctcaagctatcgctattgctttccggttgggtgttcacgttcagggtgtgtctcaccagcttgaggcccgcgagctcgacgagactcccaagacttgggcttatgttgttcacaacatcgaccccaaggatgctcaggctgagctggaggcattccacgaggcgaacttgacatcaaacactgcccgcatatttatcagcgccgttagccgtacctccgttacgatcagtggcccgccctcgaagctcgagagcctcttcaagaagtccaaggttttccgggatgcacgatcaatcgccctgcccgtctatggcggcctttgccatgctcctagtgtctacagcacaaaggacacacaagccatcatcgacggcttgaacacgccgacatctgcagctttgtccagccaagctccccaagcaccgctgtactctacgagcaccggaaagccatatgaggcagtcaacgccatcgggctgttctcatgcgtcgtgaccgaactattgaccaaagccatcgagtgggatcaagtcattgccggtctagtcagtgctgctaagtcggctgaagcaactgaggttacgctctcctgcttcggcaactcgattccactgaacgacctcaagacagcgcttcaagctgccatcgccgatgtcaagatcaccattcacagcttcatgaccgttctcaagaagaacgcaactggcggtgctcctccccgcggtacagcccagtcgaagcttgccattgttggaatgtcatgcaggcttcctggtggcgccaccgacactgagaagttctgggagcttcttgaagccggtctcgatgtctctcgcaagattccggcttctcgctttgacattgaaacccattacgatccagagggtaaggacttgaacaagaccatgactcaatacggttgctttatcgatgagcccggcatgttcgatcccagcttcttcaacatgtctccccgtgaagccatggctgttgatccccagatgcgcctgtctctcgtcactgcctatgaagctttggagaaagctggctttgttggcaaccgcactctttccaccaagctccagcgcatcggaacattctacggacaggcagctgacgattaccgtgaggtgaaccagggtcaagaggttggcacttactacatccctggtggatgccgtgccttcggacctggtcgcatcaactacttcttcaagtttgccggacctagctacagcgttgatactgcttgctcttctgggcttgcagctatcgaggttgcttgccaggctctgtggaacggcgaggttgacatggctgtcgctggtggtgtcaacatcctaacaaaccccgatggtttcgctggtctctgcaggggtcacttcctcaccaagggccagaacgcttgcaagacttgggatgccaccgctgatggctactgccgtgctgagggtgtgggatctattgtcatcaagaggctcgaagacgcagaggcggacaacgacaacattcttggtgtcgtcctcgctgccggaaccaaccactctgccgaagctgtctccattactcacccacacgctggacaccaatcttatctgtcccgtcagatcctccgacaggcaggtgttgatcctttggatgtctcctacattgagcttcacggcactggcacccaggcaggcgatttcgaggagctgaagggtgttctggacgtctatgcaccaaacacctcccctagtcgtcgcactgaccaggttctccacattggaagctccaagtccaacgttggccacggcgagtcggtcgcaggtacgaccgcactgatcaaggttcttttgatgcttcagaagaacgccatcccccgccacattggtatcaagactgagatcaacccgcgtcttcccactgatcttgatcagaggaacgtcgtcattcccttttccaacaccccatgggctcctggaaagcgcattgccgctgtcaacaactttggagcagctggtggcaacaccatgatgatcttggaagaggcccctgcccgcgaagcacgtcaagagaaagacccccgtcagactcatgttgtgaccctctcagccaagaccaaggcctcgctccgtggcaacatcgaacgcctcctcgctcatctcgagagggacgagaccgtggcattggaggatcttgcctacaccaccactgcacgcaagtaccaccactcataccggatagccatctccgcttccgatattggttccgtcaagaagcagcttacttcgcagctgaacaagattgatgctttgaagcctgtcaacaagaccaaccccccgtctgtggctttcgccttcaccggtcagggcgcatcttaccagtcgatgaacctcgagctctaccgcgatgtccccgtcttccgagagcacatccgcacccttgacaagctggctcaggctcaaggcttcccgtccttcattcccgctatcgacggctcgcaccccaaggaatatgttcatgctcctgtaatcacccagctagcactcgtctgtgtcgagattgcgctcgcgcactactgggcttccctcggcatcaagcctgacgttgttgttggccactctctcggcgagtacgcagctatgcacgtcgctggtgtcatcagcgccaacgacgccatcttcatggtcggttccagggccctgatgctcatggagaagtgccagtcaggcagccactgcatgatggctgtacgcgcctctctggaaaacatcatcgccaactcaggcggcaagccccacactgtggcctgcatcaacggcccagctgatactgtcttgagcggcacaaaggcccagatggacgacatcgccaaggacctcgaggctgctggactccgatgcatcaagcttgatgttgcctttgccttccactccgagcagactgaccccattctcgacgaatttgaggccatcagcaagagcggtgtcgtgttccatgagcccaagctgcccatcatctcgccccttctcggcaaggtcatcttcgatggccacactttgaacgccaactatgtgcgcaccgccacccgcgaggctgtcgactttgtctctgccatgaggaacgcttccagcatttccaccatcagcgacgacaccgtctggattgagattggtccccaccccgtctgcgttggattcatcaagaccaccctgccttctacccgccttgcagttccttctctgcgccgtggagacagcaactggaagaccatgtcggatagtgttgcagctcttcaccttgctggtgtcaatgtcgactggaacgagctccaccgtcctttctctggccaggtccgccttcttgagcttccgacctatgcttgggacgagaagaactactggatgcagtacaacggtgactggtgcctgaccaagggcaacactttctacgagaagaagcagaagaccatcgagcccgccatcggcaacaccaagcagtaccagtcattgggctctttggttcagaacattatctcagttaatgtcgagggcgaggcgggtagtgtggtcatgcagtccgacctcatgcagaaggagttcttggaggcagcttcaggacatcgtatgaacgacaatgctgtcgtcacatcgtctattcatgcggatatcgcttacaccctgggtgactacctctaccgcaagttttaccccaaggccaagcgcccggatatggacatggccaaccttgaggtcaccaaggctctcattgctaagaagaaaggcatggatacacctcagtctatccaagtcactgccagcaccaccaatatccgatctggtgtcctggacctgacttggcagaacgtagaatctgatggcagctgcgctgagccttttgctacagcccagatcatctatggcgatgctaagcagtggctctcatcctggagccccatgtcccatcttatccaaagccgcatcgagtcacttgagcgtctagctgtcgagggacaagctaaccgtctatcccgcaacttggcctacactctattctcctccaacctagtcgactatgccgacaagtaccgcggcatgcaatccgtcgtcatgaacgacctagaagcctttgccgaagttaagcttaccgagaagcccgacagcggcacctacgccgtgccaccctactacatcgacagtgtagcgcatttggcgggattcatcatgaactgctccgactctattgacaccaagaacaactattgcgttacttctggctggaagtctatgcgcttcgccgagcccatgactccgggagctagataccgatcttatgtcaagatgattcctaccaaggaggacccagctgtcttccttggtgatgtttacattctcaaggcagaagacaactctattgttggaatggttggtggcatccacttccgccgcttccctcgtatcctgctcaaccgcttcttcagcgcccccgagcctgctaaagcgtcgtccggtcagcaagccaagccagcacccgcaaaggccgcgcctgcacccaagcccgtcgcacaaaagaccatcgctgctgcccccaaggcacaggactttgacgctcaatctagcagcagctcggaggtgactcctcctggcaccccgctgcttgctgcctcggccaacacttcttccactagcatcaacgtcattgctgccgagccagcgaagaagggcggcaacggtatcatggacaaagcgcttgacatcatcgccaacgagacagctattgacctggccgacctggaagatgacgccgactttgccaatcttggtattgatagtttgatgtcgcttgtgctagtagagaagttccagaaggagcttgatgtcaaggttaacggcagtttgtttttggattatcctaccattggcgatttgcgcgagtggttggagaagtactatggttag

SEQ ID NO: 243 - DNA, 924 bp, Pyrenophora teres
atggagagcccttttgtgatgccgcaggaggatgtggaggcgctgggtcagtcaaaggcgttttgcgcgctgaggaggtgtcttgctggtgaggccgcgttttgcgcaacacacgcgcattgcacaccccaagccaaacaaacatggctccttcaccgcgacattctccacgccctcatcatgcctgtagtgacgctcttttcgcgcgcctcaactctggcgtcggccgccctctgtacgcagcgaacgtcggacctcgaacttgcgttttcgggtgaatcgcgcagcgctttcataggcctgcaatgcttcatcagtgaggaggctgactggtgccgcacgagagggtgtccggcttgcgtcgtctcggccacgttgagcaccgacagccatatccgcctgacaattgctgcgagcctgctcagcactgcgagtgtagccacgcccacgcaagaggaacctcgacacgacagtgataggacgctgcctccactcccgcatatccttcctgccctgcaacacgccgtgataaacgacccgttctgggaaggctcggacatctggggctacatcttgtcgcgtgccacccaactgtcggctggcatacaagccctaatcgccgagtgtgtgaatcttgaatcgctcgtctcatcgcccacaacagacaggccgggtgcgaagcgcggcttgacgcatccctcggtgccttttggagcttctggccaggccgtcgaggaaaagggcgtcaaactcagaaagagcaagctagcaaagcggcagttgaggctacgagacgaggaggttgagctgatgaggagagtagccatgcaatgctgggccaaagcccaggtaccaaagaaaatcagaggcgatgtcttgggcataagcgatggcaagaggacgaggagcttgacttgcccatga

SEQ ID NO: 244 - DNA, 789 bp, Pyrenophora teres
atggataacacgaccctcttcgacgtcaagaacaaaattgtcctcgtgaccggcggcgccaaaggcatcggccgcatgataagcgaaggtttcatccaaaacggcgcaaacgtctacatctcgtcccgcgacgcgaaagcgtgcgagcaagcatgtaaagagctgaatgcactgggaaaaggcaaagcagagtttatcgttgcggatttgtatcgggaggatgcggcgagttttgttgcgggggagttgcagaagagagtgggaaaactcgacgtcctagtgaacaacagtgggagtaactggggcgagtcatacgacacatacccatcgtccgcctgggaccgcgttctaaccctaaacctaaaacgcgttttccaactcactcaagccgttacaccccttctctctgctgccgcctccccctcgtcccccgcacgcatcatcaacattggcagcatagacggtctccgtgtcccagctctcgaaacgtttgcctattcagcctctaaagcgggtctgcatcacatgagcaaagtactagcgaaccatttgggaaagaggaatatcacggtgaataccgtggcgtgtgggccgtttgagagtaagatgatgaaggcgacgctggagaagcataggggcgttattgaggaggggattccgctggggaggattggagggaaggaggatgtagcgggtacgtgtatttggttggcgagtcgcgctggggcgtgggttaatgggattgtggtggcattggatggggggagtgttattggagctaagctttga

SEQ ID NO: 245 - DNA, 1722 bp, Cladophialophora yegresii
atgggtgtcgaggaaccaacaaataacaccatgcaagagcggcagatccaacaccaacaggtgtctccaaagtcatctgatgagagtccgacggtcgaaaaccaacccggtatagccatcgactcagctttcgaaggccgggaatggccaggcccagcacaggttgctgctgtcatgatcgccatctgcctctctgtctttcttgtcgctttggaccgcaccatcatcgccaccgccattcccaaaatcacggaccagtttcattcactcgacgatgtcggctggtacggtagtggcttcttgctcacgtcgtgcgccctcctgctccctgtcggccgtctcatgacattctactctcccaaatgggtgtttctgaccatcctggtcatctttgaaattggatctgtcgtctgtggcgtcgcaccgaactccgatgcatttatcatcggccgggccatcgctggtattggcggcgcaggtatcatgaccggcggcaccgtgctgttgacctatactatacctctggccaaaagacccaagttccaggggttcattggcatcagtttcggtcttgccagcgtcgctggtcccttgcttggaggagctttcaccagcaatgtcacgtggcgatggtgcttctacatcaacctcccagtcggcgccgtcagcatcatcttcatcacctttatcctcaagtccacaccgcctccgggcaagaaagatgtgtcgttcctgcagcatttcttccaacttgaccctctgggcacgttgttcctgatcccgtcactcgtctgcctggtacttgccctgcaatacggtggtaccatcgatccctggtcgagtggtcgggtaattgctctgcttgtcgtcttcgccgttcttgctttggggtttattctggttcagatattcaacaagaagaacagcatggttccccacggcgtcatcaagaaccgcgacatcctttccggtgctctctacatgttctgccacggcggcgcgctgacgactctggtcatctacgtccccctgtacttccaagccatcaaaggcgtcagcgcggtgaagtctggcgtggataccttcccaatgatcctggctctggtcctgggcatcatcatgggtggtgtgctgactggcaaaatcggctactacgcacccatgggctacgtctgcgtggtcttggcgccaatcgggtgcggattgatcgcgacctggacacgaaccaccaatcatagcatgtggatcggataccaggtcatcgccggctacggtctgggcattgggttccagtcgcctatgacagcggctcagacggtcctagccgactctcttgtcccgctgggcgtcgcttgcatccaatttgctcaggtcatgggtgcgacagtctttgttgctgtcgcccagaatcttcttaccactcgcctaacttccggcttggcgaaaattctccccgacttcgatcccaacgtcctagcaaacactggtgccgttgagttgagaagcttggttccggccgcccagttggatcaggtactggaaatctacatgcacgccctccgacaagtcttcttcttgtgtgctgggttggcggctgccatcatcctcggtgccgcaggcctgtcatggaagagcgtgaaggtggagaaacaggagccgaagaagcgagaagagggctcagagaagagcaaggatgaggaggctcattcgggtgaagaatag

SEQ ID NO: 246 - DNA, 492 bp, Cladophialophora yegresii
atgggctcgttaggttacaagtccgcttccgctgaagaagtcatagcctgtcaggccgccatcttcgaatgggccgagagcttcgacaccaaagactggaacaaactcgcagaaatcgttgcccccactctatatgtcgactaccgtgctgtaatgggcatgctgtgggaatcaatgcccgccgcccagttcatcgacatggcgtcaaatgcgaaatttctgggcaacccacgcatcaagacgcagcatttcatcggcgcgggcaggtggatcaagaccggcgaggatgagatcacgggatatcaccagatgcgggtggctcatcagaagtacaaggacgatgaactgtccgaggtactgtacaaggggcatgctcatggcaaagcgaccgtgcagtatcgcaggatcggtggcgtgtggaagtttgctggtctggagcctaatatccgttgggcggagcacgattatgacaagatattccatgaagattag

SEQ ID NO: 247 - DNA, 795 bp, Cladophialophora yegresii
atgaccactccatacatccccggccgtctcgatggcaaagtcgccgtcgtcaccggttctggacgaggcatcggcgccgctgtcgcggtgcatctcggccgcctcggcgccaaagttgtcgtcaactacgccaactcagccgaacacgccgagaaggtcgtcgccgagatcaaaaacctaggctccgacgcgatcgccctgaaagccgacatccggcaagtgagccagacggcgaaactcttcgacgacgccaaagcccacttcggccacatccacatcgcggtcagtaactcgggagtcgtcagtttcggccacctccaagacgtcacggaggaggaattcgaccgggtgttcagcctcaatacgcgcgggcaattcttcgtggcgcgcgaggcttatcgcacgctcgaagaaggtgggcgcatcatcctcacgtcgtccaacacttccaaggacttcagcgtgccggcacattcgctgtactccggctccaagggggccgtggattcctttgtccgcatcttctccaaggactgcgggccgcggaagattaccgtcaatgccgtcgcgcccggcgggactgtgactgatatgttccatgccgtgtcgcagcattatatccctggtggggagaagttcacgccggaggagaggcagcagatggctgcgcatgcgtcgccacttcaccggaatgggtaccccgaggatgtagctcgcgttgttggattccttgcgagcaaagaggccgagtggattaatgggaaggtgcttacgctggatggtggagcggcatga

SEQ ID NO: 248 - DNA, 1920 bp, Cladophialophora yegresii
atggcaaaagaaacacccagtctcagcaggttcatcctcattctctttactttgctccgccgattctctgcttgtctcaagcagcttctgttcacagtgaacattatccatgcctcggatgaacagaaggcacaggtctcactcgcagaaatcaatggcgggtacctcccgaggatgaactcggtctttcggcacttggagcaggggctgagcaggaatccgagcggttgggcggtaatctgcttgcaccaacaggcagatcatctgtctgacgttctgcaacctccaagatgccacaaatgtctcacaagtggtaatttggcagacagtgacgtgtctgcccccattgactgcttggccatcacgtatgagcagcttgacggaacggcgcaaaagctggcagccggcctgctttcagcaaatgctcggccaggatcatctacgttattgatgctcatcccgaacggggtcgagtatgcgcttctgacgtggtgctgcgtcctgctgaaaatcacctatgtatgcgtcgaccccgacattgtcagcgtgtccggatatcgcgggttgagagacattatgaggagcgtcaggccgtcaatcgtggtgaccgcggggctcacgcaagcagcagtgctggatatcgcgattgacgatctgaatctcgcaccacccatccgggtctcattaggcggtaaaccgtctaagggctggcgatcgttcagagacatgatcatccgcggtgcctcgcatggaagtgagattgacacgtccaaacttcgcgaagcaggggcacatgacgatcttaaccgcatcaactccatcatcttcacttcgggcacgtcggggattcccaagggttgtcccctgcgtgtagcgagcatgtgtcagatcctggaatctcagtcctggctcgtcaacgaatccaactcggctcgagcactgcaagcggcgcacaactcccggggcatcgcagcgtttcagacattgcagacgtggagagcaggtggtgcggtcgtcatgctctccaagagctgcgacatccaagagatgacgcaagcgctgagaaaccacgcaccgacattcatcgcagtgtctccgtccatggcgtcggcgattcgagaagagatgacgatggatccgttcatcgcggactcggtcaagaccgtccaggtcggaggcgaagccgtaaccatcggcgccatggaagaatgttcggccttgttcccgtccgcaaaggtctgtgtcaaccacggcatgactgaagggggcggctcgttctactggcccttcttcgatactccgctggaccagatttcacggttcggagaattgtgccccattggcgccgtggcccctggctcggccgtgcggatctggagcacgtcagtacagcgtgtcgcccagagaggcgaggtcggcgagctacacatccgtggtggcagtctgctgcgtcaatatatgggcggcagatcgccaggctcgttccgcgacgatgattgtggtcattggttagtgacaggcgacacagccatgattgatcgagaaggtctggtattcattcttggccgttcaaaagacatgattgttggcaccgccgggatcatcgtccctgtggctatcgagactgtcattcagaaatatctaggcggggcgcaggcagccgtgctttcgatccaacatcctacacgaggacaagtgcctgtggccatcatcaaagagtacgctcgtcgcacgggccccgagatcatgtcgcatgtgacgactatcctcggccagacatatctcttagctggagtcgtgtctctcaagcagcttggattgacggacttcccaagaaacggcagtggaaaggtgtccaaacccgacttggaagcggctttgcagaaacggttcggatcgaacgtgccaaaagttgcttga

SEQ ID NO: 249 - DNA, 441 bp, Cladophialophora yegresii
atgaccgccctctccctcatggcagtccccgtcctcttggaaacgacatctctcccagcccaactcttccaccagtgggtgaccatgtacggctacgggcatcgcgtgctgcccggtctcgcgatcgtcacgtgcctgatctacctccgcgtcgctttcacccggcggcgtgcaaagaaccacgcctggcccctatacgctctggcagggatcgtgactgtcagtatcgtgccgttcacgctgatcttcatggtgaagacgaatgacacgttgttcgggctcgagagggatgcgagggtgaaggggttggttagcatggatatcgagatggggaagcagcttgtcacttggtggagccgcttgcatcttatgcgctcggtgctgcccttggtagggacagttataggggtcacggccgtggtgggtgagatcaagatgtga

SEQ ID NO: 250 - DNA, 1644 bp, Cladophialophora yegresii
atgactacctcgtacgatgtcgttgtggccggagctgggcccgtgggcctctttcttgcctgcgagttggctgtagctggtgtttcggtgctcgtactggagcagcaagaatcgcccgagtcaccctggaaggttggcctgcacggcacgcgcggcctccacatccactcgatcgaagccttctaccgccgcggcttgctcgacaaggtgctccacaacatcgacgtcccagggcatgtcgggagggtgcctggctacgacttaaacttcgccgcgcactttgcctcgatccggctggaccccaaaaacgccgacttctcgcgctggaagtaccacttgccgctgccccagcccgcggaggccaagctgttctaccctgcccccacctccgtcgacacgctggagaagaccttggccgaacgtgctgaaagtctgggtgtgcgcatcctaagaggcgtggagttctccgattacacagaggacggtgagaccgtcaccgtctcggctgggaaccagacattcaccaccaaatggctggtcggatgcgacggcgagcgcagcagggttcgcgaagccgcgcagttcgaattccctggcacaccggccgagttcagggggtatgtcgtacactgcgaccttgccaacccggaagtgttgcagcgaggcttctgccgtaccgccgcggggatgtacatcttccccgcgcccggccacctgtacgtgacggactttgaaacgctgggcctcaagggcggcgacgaagccatcacgcgcgaacactttgagagcgtgctccgccgcgtctcgcagaccgagattgtcgtcaccgaactccaccgcgccatgtccatgaccacgcacctgaaacagacgaccacgtaccgcaagggccgcgtgttgctggccggtgacagcgcgcacgtccaccccagcttcggtgcccaagggttgagcatcggaatcggcgacgccatcaatctcggctggaagctggccgcgacggtccgggggattgcctctcccacactgctcgactcctacaatggagagcggcacccggagggagcccgccaactcgaatgggctcgtgtgcaactgtccctcctgcggtccaatccgtacagtctggcgaccgccaaactcatgaaggacctgattgccacgaaggacggaaacacgtttttcatcgagcacattgtcggccttacgaagctgtataatctcggcagcgcccacccggcgatcggatacagcgctccagactttgaattcgccgacgggtcgcgcttgggtgctaaaatgcgagaggcgcagcttttggtggtggactttactgacgaccacgccgtggcgaactacgttcaatcactggggtcggcagtgagatactctggatctcaacccaaggacgccatcgacctcaaggcattgatcgtgcgaccggacggcgtcattgcttgggcgtcggcggcggacaagattgacttagcggagctgaagaccgagctgggccggtggttggatctgtctaaattggagactgaagctgacgctacagcgatggtgatggagcgtatgacgttgaagaacgaggccgaaatatctgtgactgccattcccatcaccgcaacagtcgcggcttag

SEQ ID NO: 251 - DNA, 5376 bp, Cladophialophora yegresii
atgggaaacatgaagctcctctatttcagcaatgagtttccgaaggaggatctccagtacctctttcgttgcctccacaaccacagcaaggacagacgacataccattctcgctcagtttctccatgaggctactctagccgtcaaggatgaaatccgacacctctcaacagagctgaaacagttattcccaccgttcgaagatattcttacctgggctgagaatcccgagctgcgcgaagggctcctttgcggtgctgtcgacggagttctgctcacagtcgtccagcttgcaacatacattggttatgtggagaatcagccggaagagctggcgagattagaacagacatcactggcgggcctaggcatcggcttactggcactgactgccgtgtcgctctcctccgccgtggtggatttgccgctggctggtgcagatgcggtgcgtctcgctttccgtatgggctgccatgttctcgccgtttccgagaacttggaatctcgcgatctcgcagcagctccagagacatgggcctacgtgattcacaacgtcgatcctgtcgcggcgcagcaggcgctcgatgcaatccaatcgcgagaaaagatacctgacaccagcaagatattcctcagtgctgtcagccgaacgtcagtcacagtcagtggaccaccctcgagattaaaggcgctcttcagtcgctcagaattcttccgggactccagatctattgctctgcccgtctatggaggactttgccacgcgcctcatgtctacggctctcgggacgttcaaagcattgtctggggtagttcgttgaacgcaaacctcgcaaaatcctgtcccatcaccccaatttattccaccagtaccggtctgccattcagtgcctcgaatgcgggagaattattcgaatgtgttatctccgagttactcacgcatgcgatctgctgggaccaagtcatccggggcgtggttgctcaactccaaagtgctggtgccagccaggtagcgctttcctccttcggtaactcaatccccctcaacgacctcaaagcatccttggaatccagccttcctcaactcgaagcatccatcatcaatctagtaccatggattttcgacgctgcatttcccgcggcgtcaccgcgaggctcggcgcaatccaagctcgccattgtgggcatgtcatgcaggctcccgggcggagctacgaacacagagaagttctgggaaatcctcgaacaggggctcgacgtctctagacgaatcccggcagatcgcttcgacattgacacgcactatgacccgactggcaagcaaatgaacaagagcatgacgcagtacggatgcttcatcgatgagcccggcttgttcgacgcgcctttcttcaacatgtctccacgtgaagcccaagttgccgatccgcagatgcgtctggctttagtcacggcattcgaagcgctcgagcgtgctggttacgtcggcaaccgcacttcgtccaccaagctagaacgtatcggcacctactacggccaggccgctgacgattatcgagaggtcaaccaagggcaagaggtcagcacttactatattccaggaggttgtcgtgcattcggtcctggtcgcatcaactacttcttcaagtttgctggccctagttacagcattgatacggcctgctcgtctggactggcggctattgaggtcgcttgtcaagcgctttggcaaggtgatgtcgatatggctgtcgcgggcggcgtcaatgtgctcacaaatcctgatggctttgctggcctgggccacggtcacttcctgaccaaagggcataatgcatgcaaaacctgggacgccaccgctgatggatactgtcgcgcagacggtgtgggatctgtcgtcatcaaacggcttcaagacgcagaggctgacaacgacaacatcttgggagtaatactgggtgccggaaccaatcattctgccgaggctgtttctatcactcatcctcacgccggtcatcaagcatacttggcccgacaggtgcttcgtcaatctggtgttgatccattggatgtttcttatgttgagctccatggcaccggcacccaggctggcgactacgaggagatgcaaggcataatggacgtgtacgctccgctcgtcaagcggcgcagcaaggatcagcctctgcacattggcgctgtcaaggcaaatgtcggtcatggcgagtccgttgcggggacgacagctttgatcaaggtgctcttgatgttgcagaagaacggcattccaccacatatcggcattaaaacggagatcaaccctcgtcttcccaaggattttgacaagcgcaacgtccatatcccgttcgagatgacacagtggaagcagaaacccagcacaaagcgtgtcgttgctctcaacaactttggtgccgctggtggcaatacaaccatgattttggaagaggcaccgactcgcacaacaacagggagagatccacgccctacccaggtcattgccgtgtcggcgaaaagcaaggcatcattggcaggaaacattgagcgcctgatcgcttacatcgatgccaatccacagctcaacctcgctgatctctcatacacgaccaccgcacgtcgctaccactaccgcaaccgtctgacagtgaccgccccggacgccgctcatttaaagtcacagctcacttcccgtctggcgaagattgactccgtcaaggccctggcacagtccgatccaccattgattgctttcaccttcaccggccaaggcgcttcgaacaagtccatggacctcgaattgtaccgcgacgttccgatcttccgcgaacatattcagcatttggatcatctggcccaaggccaaggctttccatctttcattccggctctcgacggatcacatccgaaggatcatgcacattccccggttgtgactcagcttgctctggtgtgctccgagatggcgctggctaaatactgggctgctctgggcgtcaagccggatgtcgtcctcggtcacagtttgggcgaatacgccgcaatgcacgtggccggcgtcgtctctgccgctgacaccatattcatggtaggacgccgggcccagatgctgcaagaaaaatgcacaattggaagccacaccatgatggccgtccgagcctctcttgccaccattgcccagaactcgacgaataagccgtataccgttgcttgtgtcaatggaccttcggacacagtgctcagtggcaccaagcagcagatggatgaggtcgctgtgccactcgagaaggctggattgcgctgcattaagctcgacgtggcgtttgcattccattctgaacagactgaccctatcctggacgagttcgaggcaacggtgaagacgggtgtgattttccaggagcccaaagtccccatcatctcgcccttgctcggcagagtcgttttcgacgacaagaccttcaatgcgaactacgtccgccgagccacgagagaagccgtgagattcttccctgcactggagaacgcacaagaggtttcgaccatcaatgacgagactatctgggtagagattggccctcatcctgtttgcaccaattttgtcaaaacctccatcccatccacagccgtcgccgtcccctccttccggcgcggcgaggacaactgggctaccatggcagaagcaatagccacattgcacgtcgcgggtgtcaccgttggctggaacgagtttcatcaccccttcgaaagcagactccgcctcctagacttgcctacatacgcctggaacgagaagaacttctggctccagtacaacggcgactggtgtttgaccaagggcaatactttttacgcggccgagaaatcggctgcaacaggacagacgatctcaaaaccactgcctgtcagcgacttgcagacttcgacagtacagcaagtcgtcagggaggtcgttgatggctccgctggtacagtgatcatgcaatccgatctcatgcaaccggattttcttgctgcagctcatggtcatcgcatgaacgattgcggcgttgtcacatcgtccatccatgccgatatcgcttataccctcggtagctatttgtaccgcaaattctatcccaagtcaaaggacgtcaacatgaacatcgcggacctggtggtcacaaagggcctcgtcgcccaaagtaacaagaagctgcctcagttgatccaggtcaccgccgccacggccaacatcgaatccggtgttgttgaattgagttggcaaaacgttgacaacgccggtgacgtgcatgagccatttgccacggccaagatcgtctacggcgatgcttctgcgtggctcagctcctggctccctctgacgcacttgattcacagccggatcgaggcgctggagcagatggcggcaaaaggccaagccagccgattttcgcggaacatggcatacacactcttcgccgccaatctcgtcgactatgccgacaagtatcgcggcatgcaatccgtcgtgatgcacgatctggaggcatttgccgacgtgcagctgactaccaaggaaagcggcacctggaccgtggcgccctatttcatcgacagcgtggcccatctggctggattcatcatgaactgctccgacgcgatggatgtccggaacaactactgcgtcacacctggatggaagtcgatgcaatttgcaaagcctctcatcccgggagcaaagtaccggtcctacgtcaagatgatccccactgctgaggaccccaccatcttcttgggcgacgtgtacatcatgcaagacaacgccatcatgggcatggtgggtggcatccaattccgccgctacccgcggatcttgctcagccgattcttttccccaccagataagatggcggcgatggaggacaaagcggtgaaagttgcagctccgcaagccctactcccagccgcagcccacggaaagccagcgactaccacgcagcagcaactgccaaagccgacacgcttcagtgctgacgatgtcatccatccgactgccgtccctggaccgccgaaggacttcaaagccgccaccactgttgttgtggaagtctcgccgagcagtagcgaatccgagacgtcaagtgatgataacagcatcgtcagcaaagcccttgagctcattgcgaatgagggcgcgttggacattgctgacctggaagatgatgtccggttcgcggacctgggcgtcgacagtctcatgtcgctggtgctcgcggagaaattcagagtcgaacttgatatcaaggttggtggtggccttttcgtggactaccctaccgtcggggacctgtgcaagtggctggcggagtattacggctag

SEQ ID NO: 252 - DNA, 1008 bp, Cladophialophora yegresii
atgcaggacgataaaggaggctacaggcagatcaataaggcgttgaatatttgtgtctttgaggattacctcaagggtcagactgcagcacttccctatgttccagatgtcgagcagctcactgacagagtcattcgcatcttgggccagaatccaggaaagtttacctttcaaggaaccaacacttatgtcgtcggtaccggtaaacggcggattttgattgataccggcggtggtgagccagcatgggcacggcttgttcaatcaaccatggcgtcaaagggtatcagtctgtcccatgtccttttgactcactggcacggggatcacaccggtggagtacctgatctgctccacatttaccctcacctccgggactccatctacaagaatgacccggatcagggacagcaggacatctccgatggtcacatctttcaagtcgaaggcgccactgtccgggccatccacgtgccaggacactcggaagaccacatgtgcttcattttggaggaagagcaggccatgttcacgggtgacaacatcctgggccatggcaccagcgcggtagaagacttgggtgtctttatggctagtcttcagaaaatgtacgatcaaaagtgcctggttggccactctgctcatggcgtcaccatccaagatctcccaaccaagctcagaggagagttggaagggaaactacgtcgcgaacggcaagtcatgaacgctctcggtcggattcgtagccgtggcgggagaagtgtggcggtcaaggatctcgtcactgagatttacggtcagtctctcgacgaagagacccgtactctcgcattggaaccctttatcgacgaggtactgcggaaactcgctggtgatgggaaagtcgcctttgagaggagaggccgcgtaaagaagtggtattctgtggctgcggctcgattgacgccgagggaggtcaagatgcccacggccgttgtggttcaggtccaggagatttcagtagagtaa

SEQ ID NO: 253 - DNA, 2187 bp, Cladophialophora yegresii
atggacacaggattgactacagcagacaacaacccaatacgctggtccaggaatgaagcaccagctgcgccggctgggtcattctccgtcggcccaagcaacaacaatgacaactccacagagacgactatgccgtatgcctgccagacatgcggcaaacgaaaagtcaaatgcgacaaggcgaaacccatatgttcggcctgtcataagagcaagctggagtgtgtctatcaagcgcctcagccccggcgccgcaaacgaaagctgagcgacattgttcatcagagactcgatcaatacgagcgcatcttggcgctgcatggcctgctgccgcaagacactcttacgactacatcaacgcctaatgacgagccattacatgcccaagagccggcggcatcttccaccgggaaaccagcgtcagattccggcgcatcgaggatgggcaagttggtggcgggcgatgggaagtcaatatacctcgacagtcagctctggcgcaatctaggcgaaggacagaagcaaggcgccgctgacgacgacgacgaggatgaggagaccgaagaagaagagggcgaagcaggagaggcagaaggagaggatccagcaatgtcttttgtgggtgaccctttgaccggagcattcatcggttcgaattcaagtctgccccagaacctaacgcagtatcatccaagacacgcggaagccatgatcctatggcagacgcatgtggaaaatgtcgaacccatctgcaaaatcctccacgttcccacgacataccagatgttggaccgcgtgtcacgagaacccgacgcggtgtcgagagcagacgagtgcatgctgttcgccatctaccactttgccgtcttctcgctaacagaggatgactgtgccaggcaattcgggcaggcgcgcaacaaaatgctccagcggtttcactttgcgacgcggcaggctctggtcaacgcttccttccttcgaacgacggagatgtcgatcttgcaggctctcgtcctgtttttaatcccaggtcgcttcatctacgacccgcacacatattggatcctgacgggtgtggcggtccgcattgcccaacgcatgggtcttcaccgcgacggcgagcagttgggcttgcaaccgttcgaggtacaaatgcgccgaaggctgttctaccagctcttgccgctcgatggtatcgccagcaagatgtccggcacggggatcgccaccatgacagacccgtgggacacgcagcagccatcgaacatccatgacgaacagatctggcccggcatgacggagccgccgcaggagcggaaaggagccacggacatgatcttctgcctgacgcgtgcgttcgtcggaaaggccatggctcgagcggaacaatccaagcacgacacgcagagcaaggaggatgccgagctcctgattgccgagaccgaaagccaggtcgaagagaaatatatccgctattgcaacgtcgtcaatccgctccactatctgacggtctgtctggcgaggtcggccatcacggccatgcgtctccgggctcgacttcccaaggataagaaccaggcgatcacggacaccgaggcacgagaactgttccaactcgcccaggacattctccagacggacctggccgcgtcggcgaacacgagcctgaggcgataccgatggcatttgaggtccttctttgtatggggctcgtgggattcgctgatctataccatcacaacgctcaaaaagcctgacctgctttcgcccgcgacgacggacgccgcctggaggagggtggaggagctgtacaacagccacggcgagctcctcgagtcgaaacaagccttgcatatcgccatcagacgcatcacgctcaaagcttgggccgcgaatccaccccagagccgggtgcccgagccaggcttcgtcaccgaattgcgctccctccgtagaatgggccggaagagcaggccagacagacaaggtagtacaagtaatgtaactcctaccccaggcatggcggaaacagtcgatcagacgccctccagcgatgccaatgcgctgttgaacagcctgtctggcgttcccgggctggaaataatggatgactttagtctcgacacggtcgactggaccttttgggaccagctgattcaaggctaccaggcacagggtgggcagtaa

SEQ ID NO: 254 - DNA, 846 bp, Cladophialophora yegresii
atgttgccttttccgtccctgaccaaggaatggcactcggagccatattcctccattgacccaactcgaccggagttgtcggccaagggtaaagtcatcgccatcacaggtggagaaggcagtatcgggatagctgtggcaaaggccttcgcacgtgcgggcgccgaacgcattgcgatcgtcggccgctcagtcgacccttggtgcaatgccaagagagagatcgaatgccttggggcacgagtgctggccgtccggggcgatatctcagatggtgcctcgatctatggtgcttttgcaaccatcgagcgagaattcggcagagtagacgtcgccgtcgccaacgcgggatacctcgccacattcatttccattccggacgccgatcctgacgactggtggaaaggcttcgaggtcaacacaaagggggcattcaacacctcgcgcgcctttctggccgtggcggcgccgaaagcatatctcgtcgacatctcctcgggcattgtccacatgccagccaagccgggtgcttccagctatgtttcatccaagttggcggcgacaaagatttatgagacagtcgcagccgagaacgagggtctccatgtcgtttacatccagcccggagtggtccgtagcgagttgagtcgtaaggctggtatggcggccatggattcagccgatcttgctggccagtttgtcgtgtgggcagtcagccccgaagcaaagtttcttcgcaacaaatatctgtgggcaaactgggatgtagacgagctgaaacggcgcagagaagagttgggacagccacaccatttgactatccgaatgaatggactgcctctctaa

SEQ ID NO: 255 - DNA, 1314 bp, Cladophialophora yegresii
atggccgccaccaatccaccttcaacggcccatgccgccaactccggtcccactgtcgtactggagcttccgctgcgtaacagctgtgatgcttgtgcttcggccaagttgcggtgcaccaaggagaagccgacctgccaccgctgtgccaaacgaggcttgacctgtgagtacgtggccatcaaacgagccggcagaaagcctggcagtcggtcaagtgtcaatgaaggctctaccaactccagcacgggccgaccacgtccaccgcagagaacgcagtcgctacagggcggcaccgggcccagctctacagacaagctgaacgaacaacttgtcatgctcaaccaatctcttcccacgaccttcgtcgacctggacacagcctcggatgtttctttcaccatcgacggacccgaattcaattttctcaacacggcagagctgttgtcaagccatgtcgatggcggggccagcaattgcagctgtggcagtctcagcagcgccagcgcgagctgcgatagcaatgacggtggcggatgtaacaggcatgacagtttttcgactgctttgcccaacctcgaaagtaccgtgccggagtttttggcgctctcctcacccaatgctgcggcttggaataccgcgttcccagagctggaactgaccgaaacgtcgtgttcctgcctcgccgaagcgacaagtttcatcacacggttatcccttttgtcgtcaaccgtctgcaatacctgggccatactcgatctggataacgtcacgatcctccgagtggttctggacgtggtcgaacagaacaaggtcacaatcaacgcggtgagcgccatcttgaactgccccaactaccacgacggctgtctcctcgccataatctcattcgtcatcttcaaaatgctgagcctgtacgccgcgattgcgtgcaaggaccctaatctgcaagacctcccacagcccagtctcgcgcgcccgatgccgcaattagagtcggcgatccccagccctgccggcctcgtggataactacagcatggaaagaagtgatccccaacacatggcccgacgcattgtcctcggcgagctgcatcgcttgcgccatctgattgcgcaacttgtggaaaaactcaagtctcagtcagtaacacaggagagcggagaaggcggaaagacacaggagagtatggatctcgattgcgagatgagggcgcctctgtctacagtcatgtacgaacagttagacctcgatctccggcgacgactgaaagcactctcatgggccatcgtggatcgcatgacccggctctag

SEQ ID NO: 256 - DNA, 801 bp, Talaromyces cellulolyticus
atggtcgatacaggaggtggcgagcccgcgtgggcagaattagtcgaaactacactcaaatccatggacgtcagactatcacacatcctacttacgcactggcatggcgaccataccggtggagtccctgatctgatacggctgtatccacacctgaagcactccatctataagaatgatcctgataaagctcaacaggatgttattgatggacagttatttgaggttgagggcgcaaaactccgggctctacacgtgcctgggcattctcaagatcacatgtgcttcattctagaggaggagaatgcaatgtttacaggggataacattctcggtcacggcacaagtgctgtggaagacctcggaacattcatggatagcctgcagaggatgcttgggcagaattgcgctatcggatactctgctcacggcgtaaccatcgaagacctaccggctaagatatcaggagagcttggagccaaattgcgtcgtgagaagcaagttctccaagcgcttaacctgctacgtattcatggcgagaaaagtgccggcgttgaggacattgttaccgagatatacggcgaatctgtcgatgaaagcacaaaagctcttgctctggaaccattcattgacgaaatactgcggaaactagctggggacaacaaagtgggttttgaaataagaggaggcaagaagaagtggtactccgtagagatgttacagtcgactataattcgcaagcccgtaaatggcaaagcccattcaaatgttgacgttaatgtcaaaggaattgcggtttaa

SEQ ID NO: 257 - DNA, 795 bp, Talaromyces cellulolyticus
atgactatggcgacatatgccgttctaggcgccaccggcaactgcggcatcgctctgatcgacaacctcgtacgaagaaaggatgtgaaggtgaatgcatattgtagaaacaaggccaaattaattgcaaaattgcctcaagttaagaacgacaagcgagttcaagtatatgaagggagcatctacgatattgaccttttggtccactgcattcgcgatacacaagttatttttcatctcgttactaccaacgacaacgttcccagatgccatgtgagcttggatacagctagaagtatcatatctgccttggagaaaaccaaggtgaattcaaaggtgggcactaagatgcccaagattgtgctcctctcgtcaagcactatcgacgaccatcttagccgccatatggcctggtggttccggctccttttacggacctctgcatcgaatgtatacgccgatttacagcgaactgaggagtttctgcgttcccagcatgaatgggtttcgactatattcatgaaaccagggggtctcacagttgatgtacagcacggccaccaactcagtcttgaccatgatgaatcatttgtttcgtacctcgatctctctgctgctatgatcgaagcggctgatgacatagaaaaccgtttcgatatgaggaatgtcagtgttatcaacttgaatggctctgcaaagtttcccaagggaacgccaatgtgcatcttgatgggtctcgccaggcactttttcccgtttctgcacccttaccttcctccaacagggccggcttaa

SEQ ID NO: 258 - DNA, 1362 bp, Talaromyces cellulolyticus
atggcgttgagtacagctctcgatctctccgcatctcacttgggcatcgtgagaggacgtcccagctccgccggtgcagtgaaagagtgcaaccgcttgctacataagaaccatgagacatatcacatgttcttccgggagattgctggcatgaaccatatttcccatagccttctcacatgttttgcactgggcgccgatatccaggaacttcgagatcgttaccaggacgaggctgcagcccaacggccaatgccgcccttgaatgatgaactttgggagaagttggaggatcctaaggtgttcctccagaatatgtacgtcaagaaggaatacaacacgtttctccacttcttcgagcgacgcattgccgcaaccggctggcggaatgtcgtgcacgagttcatcttttctcgcagtcaggtcgccgagcgcatgctttcgagcatgttcgacggcctctaccaccccattattcatctcggattgggaatcgagttcaacttgcctggcctcgtggccgaggcattggctcaggctgcagctaacgacgacagcgatctccaccggctgtttggcatgtgtgagcaagaagctgcaagtcaagtcgtagctttgagtgaagaggccaagaagacatccatgctacagctactggacgccatgcgcgagaccgacgagatccgtacagccccgctgtggtcagatatgggactcaagatgcgaaacggcgtagtaggccgtgcaggcggctcctttgccgctctagccggtcgtttcagggtctcgacagaagatgaggaagaacttctagagcgtacggccgagatgatcagcacttgtgctcttatgtgcggtggtggacagcattcaggtcgtaaggaaaaaattgacttcttctggatgcactctatgaccagcagtatcttcatgagcattttagccgcacaaagggattggatctctcttgctgaccgcgctcgcctgctcgagtacaaagtgcgcaccgacctagcttggtatgtcgcgtcgggcagtgtcccactagatgacaagtacataacaaactacaccaacccagagagtgacggttggtcctgggacgacatattcagtgccgtcatcaagcagcacgatgatggccacgctgccaagttcattcgcgccctcaagaatggcgagattgtctgccagcagtacgaatctcggagcaaatcagtaggccgatttccagtcaagggagacatgtggctcaaactagctaggatgtgccatgacacgacgaaaaacatggagattgaccttaagtggatcagattcaccggttacgatgaagcatggaggcgaccagatctgttgtaa

SEQ ID NO: 259 - DNA, 1572 bp, Talaromyces cellulolyticus
atggatttcttcgaaattttcatcggccaaaggtggctctcccttcaaacttcttttcttgtgggggtttcactttactttttgtattggttgatcgtatatatctatcgagtcacgctgcaccctctggctaagttcccaggtccaatgcttgctggagctagcttttggtacgaattcttctacgatgtgtggcccagaaaatatcgatatatgtggaagattgacgaactgcacaaaaagtatggcccaattgtgcgcatcaacccgattcatattcatgtaaacgaccccaattttctcgatcagatatacgcacccgctggaaaggagaaacgcaacaatgacccgtggtttagcatggcgactgaatctgggatgatggcatggtcgacgctgcaaaccatggatcatcaccaacaccatctacgaagaagtgctctcggtcgtttcttcagcaaagcctctgtacgccagctagagagcctaatctcggacaagatcgatcaactgttgcaaaggttagctcagatgcatggtacaggcaactctgtcataaatgctacgcatgttatagctgcgctgaccatggacatcatatcatcgtactcgttgggcgtcgatatggacaatttatccagtgatgaatggggccgtgattggtctgagacgtttcctcaactaggaactatcaggccgtggggccgacagttcaaaagtcttacagtcatgtctcttagtattgacccaagcatcgtgcgctggttcaatccgactgcagctgccgtggccgagaaagcgaaatatcccatggaggttattcaggcacatgtcgataggcatgaaaaacatagtgcagcttcaaaaataaaaactaacagtaggacaatcttcatggagatactagacagtagcctgcctccccatgagaaatcgatcgaacgtctaaatgcagaggccttcctgcttcttggggcaggtaccgatcccactacacgcaatttgacggtgaccatgtatcatatcctagcaaactcggaagttttacagcgcgttcgtgatgaactcaaattagtcatgccacaaccggactgcccagtaactgtggccgacctggaggctttgccatttttctctgcatgcattaccgaaggtctccgaatgactaacgcagtttcgacgcgcattccccgcatttcacctgataaagcgattgtgtacaaggattggatcatccctaagggttctctgtatctactgcacatgaacgatgaaatcttccccgattctgctagatttaatcctcaaagatggctagacaacccgagcctcaagacacgttacttgatggcgtttggtcgtggcagtcgacagtgccttggcataaatcttgccaatgcggaattgttcctcaccttagcccgccttctcacccggttcgacttggatctttacgatgttatcagagagcgcgacattgatgttagtggagattgcttcaatggcatagtacgagatgatagtccaggaatccgattgaagctggttagagatcacctggccgaaatatag

SEQ ID NO: 260 - DNA, 483 bp, Talaromyces cellulolyticus
atgtcagagcaacctacgcccgacgaggtctttagctgcctagctgccttgtttgagtgggctgaaagttatgataccaaggattgggaacgtttgcggcaatgtctcgctcccattctccgcgtggattatcgccaggtgatgggcaagatttgggaagaaatgcttgcagatgaatttattccgctagcctcgagccctcatttcctaggcgatgaactactcaggacgcagcactttatcggcggcgcatctagctggaacaaggtatctgataaggagatacagggccatcatcaagtccgagtcgctcatcaacgctatacggatagctcgatgaaagaggtcgcgattcaaggccatgcccacggcggcgcaacgatgtggtacaagaaggtcgaaggcaaatggaagtttgctgggttatgtccaaacatcagatggggcgaatttaattatgatgagatattcgctccacggtga

SEQ ID NO: 261 - DNA, 1053 bp, Talaromyces cellulolyticus
atggcattctacccccccgacagtctacatttcccgccattatcacggccgttcctcaactcttatctgcctccattattatcagatgacaaggacacaacaaaggaagatgaactatcccgaccatttacaaccctcacattcgccacatctctcgactcttctctatctctggcaccaggtgtgcgcactaccctgtctggacctcaatcaaaagcaatgacacactacctccgcttccgtcacgaagcaatcctcatcggcgtcgggaccgcaatcgcagataatcccggcctgaactgccgcattgaaggcgcaagcggctacgaagaacacccaagccgggatcccgctattcaggctctggccgatgaggcgtcatcaaaccgcgaattgaaagatctcatgaaagttgttgccaactcgaaggcgacgcaagagcaattaaaaacatttcagagccatattgatcgggttcaagtagacacgatacgaaaacggcaaaactcactgcatcagccgaggcctataatcattgatccaaatgctagatgggtgcccagtgaatctagcaaaatcattcagttagttaaacaatataaggggaaggcaccattcgtcgtaacatcaaaatcaacatctccgcctcaggaagctcggcaagtcttggagaaatacggtggaaaatacatttccttggacactattaccagtgataaccctgatgatgctactggtacacatcaacactttgactggagtctcattctcaacactctagcaacaaaagaaaacatcaaaagcataatgatcgaaggcggcggctcaatcatcaattcgttactttcagaacagcgctatagcactctgattgactctgttatcgtgactattgcgcctacatggttgggccggggtggcgtggtcgtatctcccgaaagacgtgttgacgagaatggatgtgcgataccagcttcgaggcttacggatgttaaatggtatccgtttggagaagatgtggttttgtgtgggaggatcaaaggtgttgactga

SEQ ID NO: 262 - DNA, 1566 bp, Talaromyces cellulolyticus
atgagtgaattaaactcgtcggaaacaataacagcaagtaccgatgacctcgagaggacatacgatgatgagagaaaaggcgctcatcaagaagaacccgtccctcctatggcggaccatggcaacgactcctcgaattacagcgacgaattgcagaacattatttcaagttggaattcgcacgagcatcgcgagcatccgtataatctacctcgttggcgtatcaatgctacagccgttctgcttgctatgctggctttcttggtgcctttctcatcagcgatcatgtccccggccactggtcacattatggaagaatttgatagtaccagcgaactgctccaggcatttgtggtgtccatcttcgttctagggaacgcatttgggccactggtttgggctccattatccgagatctacgggcgcttatacatttatcacgggacaaacatcgcattcgtcgcactgacagttggttgcgcccttgcaccctctctatccgctctcatcgctcttcgctttctggccggtctatttggaggaacagtccttgccaacggcggcgcgtctattgccgacatgatgcccccttcaaaacgaggcttgtttatgggtctgttcatccttggccccgtcatgggaccggctcttggtcctatttgcggcggctttctctcgacagccaagggttggcgctgggttttttggcttgtggctatcgtgggtggttttgtggccatcataatggggttgatcactcgagagacttatgcacccgttcttcttcaccggaaactagaccgtgttcgacaacacaaggggcttcctgatggtggcttgagtgtaaaccaggatactgataccaccgtaacttggcggactattctgtggcgaggcattgtccgccccatgaaattactagtcagatcaccaatctcggcgctctgcgctatctacatggccatagcatatggtatcctcaacctgttgataacgtcgatctccattgtctatcaagcatcgtacggctggtcaacgaatatatcaggtcttgccttcatcggtcttggatccggcactttctgcggcaccatgatcatcagcactacctcagacagatacggcgcgtctgtagccgccagaaacggcgttgagcaaagaaaaccagagtatcgacttttcctcctcccggtcggcggattacttcttcccgcgggattgttcatcttcggatggacggcccaatacacagtccactggatagtccccatgattggcgaggcgcttaccggggttggtataatgattatcttcatgtccacgacactgtatctcattgattcttatacaatctacgccgcaagcgcacttgctgccaacggctttatgagatcgataggcggcggccttcttcctctggccggtttgacgatgtactcaaatctcggggtgggttggggtaatagtgtactggcattcattgcattgacgatcccaccgatctctttagttcttcaaaggtacggcgagaatctgaggaagaagtacgaacccaagaccctctaa

SEQ ID NO: 263 - DNA, 771 bp, Talaromyces cellulolyticus
atggcaagcgagaagactgttgtgctcgtcactggcgcaagcagtggcatcggctacgagacggtggccgctctgtccgccgcctcgtctgattttcatgtcttgctaggcagccgctcagtcgacaagggcgagaaagctctgactgacctgcagtcagcctatgggcaatctttgaagagcccaatctccgtcatccagctcgacgtatgcgaccaagagtcaatccaatcggtcaaaactgagattgaaaccaaattcggcaagctggacgttctcatcaacaacgctggcatcatcgtctaccaacaggtggaccaactgacggcactgcgtcagaccttcgacaccaacgttttcgcacagcagatcgtcaccgaatcgctggagccattgcttcgaaagtcagccaaaccttacatcatttacgtctcgtccgagatgggctctatcacaacacgtctagatcctactttcaagtttgacaaactccgtggcgaaccataccgtatgagcaaggcagctctcaacatgcttgctgcttgtcaccgccgtaactacgaggattggtgcaaagtcgcagctttcaaccctggctggtgtgtttccaacttgagcggaccgcagggtcttgaaatgcgcaagaagggtggtgcaagggaccctaaggagccagcccttgagatcgctaatattattctgggaaagagggatgaagatattgctaagaatggcatgcttgacactgacggaggcattttgccgtggtag

SEQ ID NO: 264 - DNA, 5409 bp, Talaromyces cellulolyticus
atgactatctacaccccaacatctggtggagagctcgacatgggcttgccaggagtgaaactcatatatttcggcaacgagtttcccaaagatgacttggaagacctttttcgccgcatacacaaccacagtaaagacaataatcactttatactaactcaattcataaacgaggctacattggcaatcaaggacgagatccggcgcctaccgactgaaatgaaacaaagtatacccccttttgacaccattttgagatgggccgagcctaacgagcttcgaaatggcttgatgtgtggtgctgtcgatggtgttcttctggtagtcgctcagctagcggcgtatatcggatatattgagaattcttccagggagtttaacgacagtacaaacttatgtcttgctggccttggaattggcttactagcatcgaccgcaatttctttgtccaaaacgctcgtcgacatcccacttgctggcgcagatgtcgttcgtttggcgtttcgtctggggattcatgtcatgggcgtatccgagaatctagaagctcgtgatttgtcagagacaccaagtacatgggcttacgtggtgcataacgccgattcagatgatgtccagagtgaactagattttatgcactctcgttcagaaactccggacactggtaagatttttatcagtgctgtaagccgcacttctgtgacagtgagtgggccaccaacaaggttgaatgctattttcaacaaatcgcaattctttcgagaaaagagattcattgccctgcctgtttatggtggattatgccatgctcctcacgtttacggagtggcagatactcacagcattgtccacgggacccatttgaaaacggtcagggcaaacttttcaccaacgattccagtctactccaccagcactggtctgccatacccattcaagactgccgcggacatttttgaaagcgtcgtgatggagctcctcacaaaggccatttattgggaccgtgtcattcatggtttggtagaccgaatgaaggaaaatgcgacatccgaagccgttctattcagctttggcaattccatacctctcaacgacctccagactgcaatcaaaaatgatgtgccctccgtcgaactctcaaccaagagtctgatctcatggcctttccatttgaatcataacgactttacacctcgcaccccagcccaagctaagctggccatcattggcatgtcttgtcgacttccgggaggtgctacaaacacagaaaagttttgggggcttttagaaaatggccttgatgtttctcgaagaataccagctgataggttcgatattgagacacactttgatccaacgggcaaggacctaaacaagaccatgactcaatacggctgcttcattgaagaacctggcttgtttgacgccccttttttcaatatgtcccctcgtgaagcacaggttgtagatccgcagatgcgcctttctttggtcactgcgtatgaggctctggagcgcgctggctatgttggtaaccgcaccgcttctacgcggttggaacgtattggcacatactatggccaagctgccgatgattaccgcgaagtcaaccaaggtcaggaggtcagtacttactatattccaggtggctgtcgagcctttgggcctggccggataaattatttcttcaaatttgcaggtcccagctacagtattgatactgcttgctcctccggtcttgcggcgattgaggttgcctgtcaggctatttggagtggtgctgttgatatggctgttgcaggtggtgtcaatgtgctaaccaaccctgatggctttactggattatgcaaaggccacttccttactcagggacacaacgcgtgcaaaacttgggatgcaaccgccgacggatattgcagagctgacggtgtaggctcggtcgtaatcaagaaactcgaggatgcagaggcagataacgataacatcttgggagttattctgggtgcgggaacaaaccattctgcggaagcagtctccattactcacccccatgcaggccatcaagcctacctatctcgccaggtcctcggaaaatgtggagtgaatcctttggatgtgtcatatatcgaacttcatgggactggcactcaagctggtgatcatgaagagatgcagggaatcatggaagtatatgcaccactgaccaaacgccgcaataaagaccagcctctgcatatcgggtctgttaaagcgaacattggacatggggaatctgttgcaggcgtttcatcattgatcaaagtactgctcatgctccaaaagaatgccatcccgccccatattggtatcaaaacgaacatcaaccccaagtttaaagatctcgataagcgcaacttgcatataccttttcagaagaccccttggcccacagttccaggtaagagacgacttttagcactcaacaattttggcgccgctggtggcaacacgacgatggtcctagaagaagccccggatcgtgttattctagagaaagaccatcgtccaaaccatgttattacagtttcagccaaaactaaaggatctttgaccgggaatatagagcgccttgttgcctatcttgatggacatccagatacaaacatcgcggatctggcatacacaacgaatgcgcgtcgctatcaccacagccatcgtgtagcaatagccacatctgatatagcacatctcacaaaacagctcaaatctcgtttagagaaggtcgatttggtaaatcctgttaaaagctccgaaccgccaccagttgcatttgtgttcactggtcagggcgcttcttacaaatcaatgagcttggaattgtatcgcgatatcccgacatttcaacagcacatccaacatcttgactcactggctcgtggacaagggtttccctcatttattccggcacttgatggctcgtttcccaaagaccatgcgcattccccagtcgttacacacttggcattggcttgcacggagatagccatggccaaatattggatttctctaggggttaagccagatgttgttctgggccacagtctgggtgaatatgcggcgatgcacatagctggtgtagtcactgcaagtgataccatatttatggtgggacgcagggcacaaatgctggaggagaggtgcaaaatcggcagtcatgctatgatggcggtacgagcctccctgtctcaaatagacgaagtctgtgctggcaagtcatataagtacactattgcctgtgtcaacagtccttttgatacagtccttagcggtaccaatcatcaaattgatgacctagcgtcggtgctcgagggtgtcggttaccgctgtattaagctggacgtggcttttgcatttcactccgaacagactgatcctattttggacgattttgaagctatttcaaagaccggcgttgtcttctcagagccaaaagtacccgtaatatcgccattacttggaaaagttgtttttgacggcaaaactttcagcgcaaattacgtccggcgggcaactcgagagacggtagatttttcatcggcgttagagagtgctcggatgatttctacgattagcgatgacactatttggattgaaattgggcctcacccggtctgtgttggctttgtcaagtctacaatcccatctacccaactcacagttgcatcgatgcgccgtggtgaggacaattggaaaaccatggcggaagccatggcttctttgcacgttgccagcgtggaagttggttggaatgaatttcatcgtccgttcgagagcaaactccggcttcttgatctgccgacttatgcttggaacgaaaagaactactggttgcagtataacggtgactggtgcttgacaaagggcaataccttctacaccaaggagcagtcgacccaggccaaatcaaccatcaagtccctaccacgaagtgaaatccagacaacatctgttcagagaattattgagcagacgttcgaggggccaactggtacggtggttatgcagtcagaccttatgcagactgatctactcgctgctgctcatggacatcgaatgaacaactgcggcgtcgtaacatcctcaatccacgccgatatcgcatacactcttggtgattacctataccgcaagctagtttccaaacccgagcaagccaatatgaatattgccaatcttgtcgtgacaaagggccttgtggctcaaagcaataacgaagtgtctcaactgattcgagtgactgctgttacgtctaatgttcacgccggcaaggtggaattgacatggcaaaatgttgacaatgacggaaacgttcacgagccgtttgctactgcagaacttcattatgaaagagcatccgaatggatttcttcttggactcccgtccatcatcttgtgcaaggccgaatcgaggcccttgagcgcttggccgtcgaaggcaaagccaaccgcttttcgcgcagtatggcatatactttattcgccaacaatttggttgattatgaagacaaatatcgaggcatgcaatcagttgtcatgtacgagctggaggctttcgctgatgtgcaacttaccacaaaagagcgaggggtttgggttattcctccctattttattgatagtttagcacatttaggggggtttgttatgaactgttctgacgcgatggacacgaaagacaatttttccgttactccgggttggaaatccatgcaatttttgaagccgttgcttccaggtgccaaatatcgttcgtatgtcaagatgattccgacaatcgaggacccaaccatcttcctaggcgacgtttatatcttgcaagacaactccatcgtcgggatggtgggtggcctacagtttcggcgttatccacgtctgctgctcaatcgattcttctcgccgccggatagaataccagccgtgggtgatgaaccaacaccacctgcaccaaaggcttcagtatcaacaccagcacatcaaacccaaaagtcaaaaccacggtcaaagtcagtttctgcagttcccactccagactccagcaatgccgtgcagagccaacgcgatactccgttgcaggaagctgctaccactggcaatactggccctgagccagcatcgtctgctgatactgcatctgcttcaggcagtatcactgccaaagcgctgatgcttattgcccgggaagcagcgttggatatctcagacttggaggatgatgccagtttctcgcaccttggtattgacagtttgatgtcactcgtcatagcagagaagtttatgggggaactaggtgtcaaagtcggtggcagtctgttcctggactacccgaccattggtgatttgcgaaaatggctggacgaatactatgcttga

SEQ ID NO: 265 - DNA, 1749 bp, Talaromyces cellulolyticus
atggtgcgtaacagcattctaaaatggagtttcctccagctcttaatcaatataaattttcagccggcatttgcagctcctagcaggcaaaatttgtcccatcatgagtacgattacgtggttgttggtggcgggcctgcagggttagtactggtagagcagctcaccctccaccctcaagtcagtgtccttcttctagaagctgggcccgattcgagtctggatccgttggtgtccactccggcttattggtttgagacatcggcatacctttggaactacacttctgctcctgaccccgccctcaatggacgtaccccggacctatggcagggccgggctctaggtggaggatcctcagtcaatggtatgggatactgtcgaggcgcatcgtccgtctttgatgagtgggccgagatttcaggtaacccaggattagcttggaactctatgttcgaggcattcaaggcaaccacacatttccaagaggacatacatccagaggaccaggtggcggtgaacctgacatcttttggtaacggccctgtcgagattactactcaacgctaccaactctcgctggatcggccgctcgtcaatctgttcaaatcgaccaagaacgtgcccgaaattgatttcgtgtctggttatggaatcggcgttacagaacagacggatgcaatccgtgctagtaaccggactcgaagctacgcatggaacactttcggctggcttgcagcaaatcgtcccaacttcgaggtacggcatgatgcctgggcatcgagaatcggctttaccggcaagaaagccgactctgtcacgtataacgacaccttgtcgaacacgatgcacacagttacagcaaataaggttgtcgtatctgcaggggccattggtagcccacagttacttatgctctccgggattggtcccacggcacatcttgaagcattaaatatctctgtcgtacatgactcgccaatggtgggacagaatctgatggatcatcactatgcacaactagtctttgaggcctccccgtccttagatacagtgtggcagtttaccggcaatgcaacgggaaggcagattgccgaagccgagtacgatacgaacggcgatggtctcttagggggtgttgacggaaatgtgttcagtgccatacgattgccagactcagttttcgctggattgggcaattaccacacgagtctgccagcagaccggccacatttcatctacgaatatgcgacggttcctttccagacgcagtatcaaaaccaaagcgttattacaccttttatggcactcgtccagcccgagggtcgtggtaatgtgaccttggctacgaatgattaccgcgaccatcccatcattaacgcagcttactgggctactccagccgacaaagccgcgatactgtacgcatacaaggactatcgttcactcatcggcagtcctgaactgaagcaatatctcccagtagaactgttcccaggagcgaatatcacaagcgatgaggacatatggtctgccattcagcagtcatcgggtagttttcatcacccgatgggtactgtcgccattggctccgtgttagatgagaattggcgtgtccacggagtcgagggtctccgtgtcattggatcgcccgctgcaccaaaaataatcacttgtcatactatggctacctcttacgcattgggctatcgtgctgcgcaagacattattgctgcggatctctcttga

SEQ ID NO: 266 - DNA, 804 bp, Talaromyces cellulolyticus
atgcctacatacgccgttctgggaagcacaggcaactgtggttctgctgtagtccgtcgtctcctcgagaaatcccctgatacgcaaatcaaggcttattgtcgcaacagggctaagttgtacaaagtggtacctgaagtccttgataataaacaaatcgaagtgtttgaaggcagcctcaacgatgatgcgctcatggatgatctgctacaaggcacaaaggcggtattcctagctgtaacgagcaatgataacatcccgggaatccgcctcaataccgacactgccatggcagtcctgagatctatctatcgactgcgtgatagaaatggcccggcttcatacgtgcctccaacgctggttcagctcagcgcgagtgcaattgatgatcaccttgcaagcaccatgtccaaatatttccgctggatcattgttcgcgccgcctccagaatctataccgatcttcagcgtgcagaggatgtcatgcgatcgcacgaccattggatcaaatccgtctttatcaagccgtccggcctgtcgcccgacatagcccgtgggcatcgtttgacctttgacgagcaggagagctttgtgagctatatggacattgctggaggcatgatcgaaattgcagatgatgaagacgaccggtatgttgggagaaacgttggtgtcgtcaacgtagtgaaaggccagggagccaaggtccctagaggcacgctgatgtgtattacaatgggcttcgtacggcactacttcccatggatgcatccatacctgcctgaaacgggcccggataaataa

SEQ ID NO: 267 - DNA, 798 bp, Talaromyces cellulolyticus
atgacctctcaagacgtccacgtaccatttcgcctcgatggcaaggttgcgctcgtcacaggctccgggcgtggcattggcgctgctatagctatcgaacttggtcatgctggtgccaaagtgatcgtgaactatgctaagtccaaagagcctgctgacaaagttgtttctgaaatcaaaaagttcggctccgatgccgtcgctctacaagcggatgtaagcaaggtttctgagacagtcaaactcttccaggaagcccttgaaatctggggcgggttggatattgtatgctccaacgctggtgtcgtttccttcggtcatcttgaagaggttaccgaggaagagttcgatcgtgtttttactataaatacacgcggtcaattcttcgtcgcccgtgaagcctataagaacctgaacgaaggtgggcgtatcattcttatgagctcgaacacagcccgcgcctttgcagtcccccgtcattctgtttattctggctcaaagggcgccatcgagtcttttgtcaaagtgcttgctatagactgtggtaaaaagaagatcacggtcaatgctgttgctcctggtggaactgtgaccgacatgttccacgccgttgcacagcactatatccctaatggagatcagtatgaaccccaacaattgcaagagatggctgctcatgcctcgcctctcattcgaaacggttatcccatagatatcgctaacgcggtggtatttttggccagcaaggagggagaatgggtcaatggcaaggtcattggcgtggatggcggggcctga

SEQ ID NO: 268 - DNA, 795 bp, Endocarpon pusillum
atggctccaagagtcgtcttgatcacgggtgccaacactggcattggttttcagattgtgaggtcactctgcagctctgatcaagcttacgacatcatcgttggtgggcgatcgctgtccaaggctgaggatgccatcagctccgctgttaaggagttcccctcctctcgcagtaagctttttccaattcaggtcgacattgagcaggatgactctatcaaacacgcgttcaacgaggtgcagtctaagttcggaaagcttgatgctttggtaaacaatgctggcgcgcagctcgaagcgcagtttgccgctggtaagctgacggagcgcgacatttggaaccagtcatggaatatcaacaccgtgggggcgcaagtaatgacctcaagcttcatacctctcctgctccagactcctgacccgcgcctgctgttcatcacgtccaacgcgtccactctcgctggaaccgagaaccttgctctacccattgaccgctctcctcctaaagggtggccgaaacgcggtttcagtattgcggcataccgcagtgccaaaagcggcatgaacatgatgatgcgtgaatggcaccgcacgctgaaggaagacggtgtgaaagtatggtgtcttgctccaggtttctcggctacgggccttggtgggaatccggaggcctcaaagaaaatgggagctggtgatccggcggtggcgggccctttcatcaggagtgttttggagggtgaaagggatggtgacgttggtaaggtcattacgaaggatggtgtgcaggcttggtga

SEQ ID NO: 269 - DNA, 2343 bp, Endocarpon pusillum
atggcgccatcagagaaaccgacgcagtcatggtctactcatgacatagcttgtactcattgccgcgaaagaaaaattcggtgcgggcgtgagagaccacaatgtgcacattgcaggcgtgatggagtggagtgcgaatactcaacccctggcaagagggtcaatcatatcaagctattatgcaacaacattggcggtcttgaggatcgcctgagtaacatcgagggcgagctctcacgcttgatgacattactcaaggccggtgttcatcaaaggccgttcatggataactcaacaaccgaagagtcgtcagccactttatcaatcaaggactctcttgccgacgtgacatcctgttcgttgccgacgcatgatcagggggcgtgccgtcataatgatcctatagatcgtcatcatggtccttgcactttgttagctctttgtaacgccttcagcgataccatcttgtcggagcagtggacacccggcccggctccgggcaaggaccagttaccaaaatccaataaacaggaagacttcgcaaagaatgaagcagtcaaggacgtgctcgtccgtatgtgtctcgaagccggtattgaagagtcttttgatcttcaaccgaatcacacccccatccgacttccacccaagcagttcctcttcatgatacaaaatcaatgctttcagcaagcagactacgcgacagatatatttgtgcaatcatccttctggtctaacgtggaacgaatctatagccaaccctttacgccggccgacaaagcttgggcgatctgcttcaacacaattatcctgctggtccttgggtcagaagtgcaaattcaaaacagtgatccaatagtcgaatcacagttcgtcctaccattcctctcaacagttcgcacagctctaaacaatcctcgcgtcctgatggcgccaaagttgatcaatgtgcaggctttggcacttttgagtctcgctgctcaacagtactatccgccaggttttgcggactcgatttttgcgcaagcttgtgtactagccagaaccctaggtctccatcaaacgccgatggcatcagataacgctagtccagaggaacagcaagagcgcttcaaagtcttcaaatcattataccttcgagataagagcttcacgatttcgcgaggatctttctgctggcttccaggttccgattgcagtctctcctctcagctcgaccagagtgccattgctgatccaaaactcgcctctcgggtacaacttgccaagttgcaagaggaaatctaccgattatttcatccagcggaatcacaaaggcgatgctcgattaggcataagactttactgttacgcatcgagcaaagtcttgagcgttgggccgatacccatgatattttcacctcagttaatactaaccctcgcaatgtcgacttgcaactcgagtttttagcggcccgcatcagtgtcctgcatggcagtcttgagcccgttcattgtgatcagtctatgtttcagcgacctgacggtctctcaatctcgaaaagcccatcgctgaaaggtctcaacaaatctaccagtcgtcgatcgagcaaagacaagacctccagcaacgacgcttgctctggcagcacagaggaaaatgcaaatcaacctatatcgttacgttcacaccgtctgccagatactttctcggcacacggatttttcttactagcaaggaatcttatacagccaatatcaacagacgatgaatcacaagcagacgaagacatgaatctattgcagaaagtatgcgcatgctacagagaacttgaagggggaagtcaagcgaacaaccacacgcgcaaagttggacacgctttcggaagacttttgcaagtggtaaacctcgttaaaaatgaccaacaacttcaaccattaccaaccatgctacatcaggcaagcaccgctcatactccacccagcactcaaaacttctttgctggccaacaaggactttccgacttcacagacctgtcgactgcatcgtcttacccagcacctcccatgccattggagggcttctcctccaagaataactctaccgcagcgaccacctcggtcagtacatgcccttcacctggcttacttactccaatggaactggaattcttttctccacatttcgagcagccgcagagtataatgtcaccgtcgggcaggaagcgagtgcgtttaagtgggccgaatgctgttatggatgaatcacccaactcgaggcttctttccgaactcctggccgcaagccctatgatgtcgtttgatgttgcggcgcaagaggacatacataccgctgtattatag

SEQ ID NO: 270 - DNA, 1563 bp, Endocarpon pusillum
atggattctgctgcagatcttcgagggcgaggtagctggagctatagcgcagccgaatatcctgtggtcgctgtgacggcctgctctgttctcctaattctatgggcgatcgctcatatcctttataacattttccttcatccgctcagaaatcaccctggaccaaagctctgggccgcaactcgcgtaccatggtgttggtatcagtaccaaggcatcctacacgagcgtttattggagcttcatgtcaagtacggtcacactgtccgtatcgctccttacgaactctccttcacctcagacacggcatggaagacgatatatggacacagatccgtggagatggacaaggatcctgtttttcgccttcacactcctactggagcacagaatatcctggtggccgaccgccagacgcatattcgccaaagacgactgctttcccatgcattttctgaaaaagcacttagggagcaagaaggtattttacaaacatatgtgagcaagctgttggaacagctatctttgagatatactgcaggaccgctgaacatggtcgcatggtacaatttcacaaccttcgacctgataggagacctgtcgtctggcgaaaagttcgggtgccttgacaagggtgattacgtccccttcgtccgcgcaacggagaggatagcaaaagagctcaccttcacccaaatgctaatctacttcggcgtggcgggcgtccggcaattcttcttgcccaaagctgtggccggccagcgcgctcagaacatgaaacgcgcaatcgacaccgtggagcgacgaatccaacgggacactgaccgaaaagacttcctctactatatcctcgccgccaacgacgagaaaggcatgagcagggcagagatccatgtaaattcattttccttcaacatcgccggctcagaatcaagtgcgactgctctttccggaataacataccacatcctcacccgctcatccgcctactcagaactcatccacgaaattcgcacctctttcacgtccgaagaagagatcacaatcgccagcaccaacgacctcaaatacctcgaagccgtcatttccgaatctctccgtctctacccgcccgtcgccggcaccctcccccgtgtcgtgcccgccccaggcgagaccattgatggcatccatgtacccaccggcaccactgtcggtgtccaccacttctcttgcttccgccacccggctaatttccaccgcccagacgagtttctccccgagcgctggcttccggaatgcaaagatgttccgccgtttgacaaggacaacagggcggcggtgcagccgttctcattcggtccacggaattgtttgggaaagaatctagcacgagcggagatgaggctgataatggcgaagctgctgtggaggtttgatttagagttggttccgggtgggggagggagcgggaagggaatgggaatgggaaatggcaagagttggagggatggacagaaggtctggggtttttgggtcaagccaccattgatgtgttggctgaggcctgtgagtagagattga

SEQ ID NO: 271 - DNA, 6495 bp, Endocarpon pusillum
atggatgattcagtccagccaaacccctccatgcctcctatactagtagggtccacgcaagcttcgtgccaactattcctctttggggatctaaccacatctttcgagcaagaccttcgtcgacttcttcatgtcaaagataatgctaccttacattccttcttcgagaaagtcagtgctgcctttcgtacggaatttgggaaactccctgctcgtcagcaagccttgcttcctcgctttaccaccattaccgatcttcttgcaaatttgggtgagacagaaggaaagccagccttgagtttcgctctccactgtctctgtgagattggtcaattcattagatattttggagaaggatccagaccttatcctagcgatgccaacacctatcttgtggcactgtgcactggctcgtttgctgccgctgcaatcagtacctctcgaacactttcagagttgattcccgcaggaatcgaagccgttcttgcagccttcaggaccggtctgtgctcgctggagcttcgaaatgatatagagcggccgagcagtcgaatacctcgatcttggtccgcgattgtgagtgcttcagaagcacaggccgctgaacttctgcagagtttcaactcaaaaaacactctatctggaagctccaggctttttctaagcgccgtttcgccaaacagtataacaatcagtgggcctccaagcattctacacaactttctggcttcagtttctttgaactcgtattgcctaccgaacgagtcgccgttccatgctccttccctgtttgggtcttatgaggttaatgagataattagctacttccctgatgaattgcttggttcatacaagccgcgaattcctctgttatctgctgcttccggcaaacctatcgtcgctgaggacttcaagaccctgctgcatacggttgtgtcagacactctgtgcgagcaggttcgatgggacaacatcctccggtcgctcgtggaagatgtcttccagcagaagtccttcaaagaatgcacaatatcacccgtattgtctaatgctgctcacctcctctcttcagcaataacgcgcgccacaaaaatcaatgtcacaacgaccaatttgttgaatctcggcgtctcggactcccagcctgccaggcctactggtaaattcgagcagtcaaagatagccatcactgggttttcaggtcgtttcccggaagctgcatcgaatgaggaattttgggagctgctaagtgcaggacgagacgtccatcgcacaattcctgaagatcgcttcaactggaaaactcacttcgatgcagcaggtaaggtaaagaacacaagcagggttcagtatggatgcttcatcaatgagccaggattatttgatgctcgatttttcaacatgtcccccagagaatctcaaaacacagatccagctcagaggttagccatcacgacaacatacgaggctatagaaatggcaggattggtccctaacaggacaccttccacacaacaagaccgcattggtgtcttttttggggtgactagtgatgattggcgagaggtcaatagcggccaaaacatcgacacatattttatccctggcggaaaccgtgcatttgtccccggacgcataagctacttctttagattttctggtccaagcctgagtatcgatacagcatgttcctcaagcttcgctgcaatccaaacggcgtgtaactatttatggagaggagaatgtgatactgcagttgccggaggaaccaatgtactcaccaatcctgacaactttgctggccttgatcgtggacacttcctatcgaccacaggaaactgtaatgcctttgatgacggtgctagcggctactgcagagcagacgccgtggggtccgtcattctcaagaggctcgaagatgcgcaagcggacaacgatccaatctttggggtcatcgatggagcttttacaaatcattgtggtcaaacagaatccatcacaagacctcacgagggcgaccaagcttccgtctttaaccggatcatgaggaattccaacgtcaatccactggatgttagctacatagaaatgcatggaactggaacccaagcaggagatgctactgagatgaattcagttctatcagttttcgtgcctggtcgcgagcgaatgccacaccacccgctatatcttgggtccgcgaaagccaacgttggtcacgcagaggcagccagtggtgtttctgctttgatcaaggtcctgatgatgatgaagaacaaccagataccaccgcattgcggaatcaaaactaagatcaaccgtaactatcctcttgatctcaaagagcgcaatgtcaacattgcgttgaaaactgtcccttggcatcgaactgattgcgtcggtgggaagcgcacatgttttctgaacaatttcagcgccgctggaggtaacacagccgtgctcctagaagacgctccgttacctcaatcagaaaacacagcaatagagactcgctcagtacatcccgtcatagtgactgcaaagagtgtacagtctctgaaacaaaatatcgagtccttgatcacctttcttgagaagaacccgagcacctcgcttccatcattatcatacactactacggcacgacgaattcaccacaattaccgcaccatctgctcagggtcagacatcgaatccattcgggacgctctcaggcagaaagccagcagttccgacatcaagcctattccaaatgtaaccaagcttccgaaggtggccttcgtcttcacaggtcaaggctgtctgtatgcaggtgttggcaaacagctattcgagacggtctcgcatttcagagctgatattcttcggttcgacaacatagctcagcggcaaggtttcccaagctttttgcctgtggtcgatggtagcgtcgccaatgttggtgagctagagccagtggtttcccatttggcagtgacatgcgtgcaaatggcgctttctcgcctctggatctcttggggtgtggttccgagtttgacaactggccacagcctgggagaatacgccgccctctatgcggctggggtcgtgacagccagcgacgccattcaccttgttggtaccagagcacagttgctatcgaagcattgcaataaaggaacacatactatgctggccatcaaagcatctctcgactccatcaaaccccgtctaagcgcctccgtctgcgaagtcgcttgtttcaaccagcctgccagcaatgtgatcagcggacccagcgaagaaatcagccgcttaatgagggaatatcaatcagacggtttcgaatgtatcgagctagacataccgttcgcttttcattcagcacaagttgagcctatcttggagctattcgagagggcagccaacggcgtccagttccatgccccttcaattccctacatgtcgcctttgctgggccgcattatctcagatggtgatgtgttaggaccatcataccttgctcgagcatgccgcaatgcagtaaacttccaaggtgctcttcaggctgcgaaagcttcatctgttgtcaacgagaagtcagtctggttggaaattggatcgcatccagcttgttctggcatgatcaagggaacgctgggcacacatgccttgacaataccgtctcttaaaaaagctacagacacgtggaaagtgctagccagcgggctcgaatcactttatctcagcggcattgagatcgattggaatgaatatcaccgagactttgagagctcgcataaggttctagagcttccaaggtactgttgggatttgaagaattattggatccagtacaggaatgacttctgcctcaccaaaggggacgatccaccaccacaaaaagaaattggtgctgctcctgctgttgagcagaagcctgtgcctctctatatttcaccctctgttcaacgtattcttgaggagcacaatgcagctgatgtgtcaactcttctcgccgaatcagacatacacgatccgcgacttgctcccatcttccaaggccacaacgtgaatggtacagctctatgtccttcatctctgtatgccgacatcgccctgacggtcgttgattacatgctgaagacaaacgatatgcaaaatgatactactggccttgacgtgggcgacgtgaaggtcgacaaatcgcttatagctgattctaacgctgtgacacaactacttcgtatttcggcgtccgcaaattggtcaaccaaagtcgtttcacttgccctctacagcattaacgcacagggcagaaagttagccgatcacgcgaaatgccaggtccggatcactgaaaagcagtcatggtttcaagagtggaagcgcagctcgtatctcatcaagagcagagtcacatcactttacaaaggagtcgatggaggcgattcgcaccagatcaagcgtggcatggtctacaagctgttctcttccattgtggactatgatgcaagatatcaagccatgcaagaggtcgtactcgatagcaacgagctcgaagctaccgcacaggtgtcattccaggttgatgatgaaggattcaacttcaacccttgttggattgacggccttgggcatatcgctgggttcatcatgaatggaaatgacaatgttcactcgaaggaccaggtgtttatcaatcatggctgggataccatgcgatgcgcgacgaagttcaggaagggcaagacttaccgaagctacaacaaaatgcagcttgtgagtggatcattatacgcgggcgatacgtatattcttgaggacgacaacgttgttgctgtcattgaaggtgtcaagttcgctggaataccgcgccaagtcctgaaccaggtattgcctccaaagtctggagcagcaggacccgcagtgactaaatcgcgttcttcaacgcaatcaaaaccggtgccgatggccacagccaatccgcttccaaaatcaactcgcacagccacggctactccgctccccaaacaagcaatatcaccaccaaactccaatacaaagcataccaaagcgtcaccgacgaatagcattgtgcccctagtattggcaatcattgcagaggaggctggcctcgacgcggccgagcttggaccaagcagcgaatttgccgattatggcattgactcattgttgtccctcaccataactgggagaatacaagaagagctcggactcgatctaccctcttcactctttgtggaccagcctactgtgaaggaatttacagtgttccttgatagtagcaacaacaggcccttgttgtcaagtccttccggcaactcgacgccagtctcaaatccagagcaagaaaccctttcggaagctacgccggaagactacgaaacagacgcaacatcagttacagacggccaaagcgtgatggaaatcatccgcgccacgatcgctgcagagactggtgtctctcttgaggacttgacaccttcgacgagtttctcagagcttggtgtagattctctgctagcgctcacgatcatgggaaagcttggtgaagtcttagaaacggatcttccgcaaacacttcttgccgataacgacaatctgtccgagatcgaaaaggcattgagcctgaagctgaagggaccagacctcaaccgaaatcctgtggctacttctccaagagcggacccgttcgaccccgagatgcctcctcacgccacatcagtcaagctccaagggaatcccaagaatgccacaaagacaatattcctctttccagatggttctggatcagctacctcgtacgcttcaattcctaaactctcgcccgagatcgtggtgtatggcttgaactgtccctggatgaagacaccacaggatatgaaatgctccttggaacacctgacaagcaaatatattatcgagatccgccgtcggcagccaaaaggcccttattactttggtggttggtcggcgggaggaatatgcgcatttgaagctgcgcaacagctggccagccagggtgaagagactagacgactgatattgattgattcaccaaatccagtcggcttggagaatccgcctcagcgcatgtacgacttctttgaaagcttggactttttcggcatgaatggcaaggcggctccaagctggctacggccccatttcaatgccttcatcagcacgctggatcattacaaggtgaaacctttttcaggtccacggcttgagactcacctaatctacgctcgtgatggaatttgcaaacatcccagtgatcctcgaccggagattcgccccgatgatcctcgggagatgctctggcttctcaacaatcgcactgatttcagtggcaggggctgggatgacttggttgggaaggagaacctgaagatccaagtgttggacgaggtcaatcatttttcgatggtggcgcctggtccgaaaattcaagagctcggtgctttcatcgcacgtgcaatggagtga

SEQ ID NO: 272 - DNA, 432 bp, Endocarpon pusillum
atgtcgaaaaaactcttcgccttgaccatctgcggctatcgcaagtcaggcatggacgaggacgaataccacagatacttaagcgataatcatgcacctttactgaaggatctgttgatcaagaacaagattattgattatacaatgcaacacaacacgagcgaaaccaagaagatgatgggccaaatattcggaagtctgcatgctggcaacgttgctgagtgtgactgcttcgtccagattgtattccgggacgttcaggacttcatcaacgtcaaagaggacccccattacaagaagatggtggtgcctgatcatgagaacttcgctgatggcaagaggactacaatagtgactggctggttcgagagtcatattccaagcaggcacggtggagcaattgagaatggagtctcgataaatggacattga

SEQ ID NO: 273 - DNA, 1146 bp, Endocarpon pusillum
atggccattcactggtccctcgaccatctcgagaagctcctccccaagcgactcttcgctaagctctcagagatttcttgcaatcccaacgttcccatagaagctggtggtaattacccaatcatcaatgccgagaccggggatctgcttgccggcgtgccgtacgccaggggattccgcgttcccaggagcaaaatgcgcgctttgtgtgctgaaggaattgatgtccagtacggcaagaaccttacggatcttgcgttcagcgagaagggtgaccttgtgttcgcctcgtttagcgacggcacgatcgcccaaggctctgtacttcttggcgccgatggcccacgctcgaaagttcgagaattcgccatgtctggagcagaggcagcgcaagtcagcaagtttccgatctgtcatcacaatatgactgtttgctatcgagatgtggataaggcaaagtatctgagacaacggtttccaacgagctatttggctctgagccagaagtcgcaccacgcttttcagtcgatctctagcatgcctgatggtcaagaccatccagaaacatggttgtttcatctcgccatggcctggctgggtgacccggagcactcactcagctacgaagagcgtcttgccatcattaaggaacgtgcacaaggtatgggcgagcctgctcgatcagcattcacgtggatccccgaggacaccctggtccacaaggcagacatcagctattggatcacgcaaccgtgggacaaccgtggaggtagagtcacccttgtaggagatgctgcgcatcccatgccaccctatcgtggtcaaggcctcaaccactgcatctgtgacagttctcacctcctcgatggtcttgagctcgtacgtgccaacaaggcaaccatcaaggatgccattactgcctacgatgaagaactcgtccctcgcggacgtgacgaggtcaaatgctcgttggagaacggcctcatgctgcatgactggcagaaggtgaaggagagccccgtattcaggaacggattcaggcctatgactggtcacgacggcaaggaggctcttagtgagcatgcgcaggcgcagatgaagagggatgaggaggagcagagggatatccctgtcgctgcgacttga

SEQ ID NO: 274 - DNA, 1080 bp, Endocarpon pusillum
atgactacatttgtagaatcatccatctcgccgcttttcgggctgtggcagcctcttccccacttgaaacatctctattatggttcgtcttgcgttcaaaagcatctattcgcgactctcccttcacacgattcgaaagttttcatcgtcacaggaaattctatcgcgaccaagactcctcttcttcaacaagtcgagactttactcggagatcaccatgcgggaacattcaccaaaatcagacaacatgcgccaatggccgatattgaccaagccacggagatcatcgccaaaaatccgttggttgatactatcttatcgttgggaggtggatctcccatcgattccgcaaaaacaatatcattccgcatgcatgagagaaatggcaaattcctgacacatctcacgatccctacgacgctgagtgctgctgagtgcacgataggcggcggctacacgaaagcagacggtgtcaagacttcagtaatgacgcccgaaattggtgtgactgcagtattttacgacccgggctatgccaaatatactccgttgaagctatggctatcgactggtatgcgtgctatggaccacgccgtggaatcacaatatcagccatacgcgtcagagatgccatggagggcaatgtcgtcttgggcagtgtccaccttctttgaatgtctaccaatagccaaggcatctcatcccagcgacgaagacgttataacgagattactacttgctgcgtttgccagcttgggcttccgcgatggagagactagctgcctcactctcggtcccgtggtccagcttaaggcgcgggccaagcaagaggacgcaaaacaaattgcaagactcctgccttggattggcgggacgtcgagcggtgatgatctcaaagatgctttggaggtcggatgcaagatcagtgcgttagtagagagcctgggattacatcaaagccttacagagaggggtattggcagagaccagattccaatcgtggtggaacgggctactggtggtttgaaagaaggctcactatatgacatcgtcacgcttttggtcgagggtttatactaa

SEQ ID NO: 275 - DNA, 1311 bp, Endocarpon pusillum
atggcgcgagaagccaatactgccacgatgctcaccctcgctggggaaatctttggtcaaacttaccagttggaaaagttcatgaaggagaaatccatcaaagaaccttctcttgccgttggagcctacactgagctatggtcgtcccacacgacagaaatcgctacagctcagaccagcatcctcgacttaacccagaagctcacaaaactcctctatggaccacacggattcctgcatgagtatgtttcctcgaactgggaatacggtgctctgtacacagttctcgaattcgacatcctcgaaaagatcccgcttgatggagaggtccacgtatcagagctggctatgctgtccggcttacctgagaacaagcttctgcgtatattacggttggtcgcctgcgagcaaatcttggaagagacctccgaacaggtcttccgccatactgtgatatccgaggaattggtgaggaacaagaagatgaaggcatgggttggattccagttgtttgagacacgtgttgcaagcgcgcatttggccgactcactcaagcatcgcaacgactttcaaactgggtcgtcggctttcaaacacgcctggggagcttctatgtatgactggcacaaagcccatccggagaaattcgcccgttttaacctggcaatgcagggtgtcactcaatctctcgacccaggaaatggtcttttctgcgactggttcaatagcaacaagcgaaacaagcaccgcaacctggttgtatacattggcgctagagacgggcacgtctaccagtatctagcagagcaatatcccgacatctccgtcgaagtccaagacaattcggaacaactcctcacccaaggccaaaaatccctcccaccagacctccaaccccgaatcacctacaccaagcgcgagatcttcaccccgcaacccgccccctcctccccagacaaccaaaccctcgccttcatcctccgcaacgtcctctggaacctctctgactcggacgccatcaccctcctccgcaccttcatccccgttctcgaagcctcgccagaaaccgtcattctggtcaacgatatgttgtcacccgcccgcggcgaatttgacgcccagaccgagaaagcatatcgcagacgcgacatcacggtgatgacaatgcataatgcgaagcagaggacggagggggattggaggcagttgttcgaggcggtgagtccgcattttgtggttagggggtggacggcctttacgagtcatgcttataggggtctttgggagattaagtgggtgcttgcaaattaa

SEQ ID NO: 276 - DNA, 1020 bp, Endocarpon pusillum
atgcaattgacaactactcaataccaagccattggaaaaggggggcccttcgccgtcgtgtcagttcccaaacctaccccgggacacaatgaagtctctatccggatggaagcggttgctttgaatccgttagattggaagaaactgtactttggcgccatggtcgagagctggccgaccgtgttgggcatcgacggcgccgggattgtggaagctgttggagagggcatcactagatacaaaaccggggacgaggttttcagtctatttgggcatgagacgaaggctgcttctttccaggaggttgccgttgtgccagaacactacgttgctaagaagccgggaaacataagcttcgaggaggcagcatcactacccatctgttactgcaccgctggctccgccatctactacggcctacagatccctctcccgtttctcccagacggtacaactagcggcccacagccgaagtccatcctcgtccttggcggcagctctggtgttggtgcttccgcaatccagatattgcgccttgcgcttccctcggctaccatccttacgacgagctcctccaagcatcacgtctacctggaatctcttggcgcaacccaagcttttgaccagaagtctccatctttgatcgaggacatcaaatctgcaacaccagaaggcaagggcgtagaaatgatccttgatgcagttgccagcagtgcttcgcagaaggatatcttcgataccctcagtgcagatggaccgaaggagtactcggaagtgttcaccgggacaccgaccctggtaccggatggagtcaagagacacgttgtatatgggcggaagttattcgagacaccgggaggacaaaacgtgatgactgctttggcagacttggtaaggaaaggggactacaaaatccccattcaggtaaagaatgtgggaagcgggtttgaggctattggacctggattagaggaattgaaggctggtgtgagtgcgacaaaattggtggtcacaatttag

SEQ ID NO: 277 - DNA, 1551 bp, Talaromyces cellulolyticus
atggcgaatgatcaggctgttgtcgacgcattgcagatctactatccgaggttctatcagcacccaactgtgcagaaattgaaccaagctgttcttgatagggtgggaagcccggagaatacgcgatgtatggtttttccttccaaggacgcggcaaagagatgctgcgcgtacattcgcaagagaaaggggcctaatattatggttcatgatgtatccttctctcttactcaacacgtatcccaagcgaatcaaacttgggcccgcttcagtgctgttctgttttcccaggaggacaaagacgctgcgaatgagttctggggagagatgggggatggaatctccagtcgccacgcacaattttgcctggacagattccaattcatgagctcggtttcgttagtccccgatctacaaaccggtgaaaccggtagctatggcgaaacgattcctatggaaccgtggcaagattccgatgccgacgccaaaaaagacattacaacaattattgcaagacttgtcacgtcagatcaacctgggcaagaggcagtcaatccagatgatgtctaccttttccccaaaggcatgtgtgccattcgcagtgtggcaagtatacttgctccaggatcagcgaaggcttctgaggcagttgtgttcggatggccctacggatcgacacctaggtgtgttagggcgagtgagtatgagcgtttcacattcttttctcaaggtacatcagaagaattggaccagctggaagcgtcactagcatctggcaatcggatcgctagtctcttctgcgaagttccgtcgaatcctctatgcgcgacgccagacctccatcgcattcgtagtcttgcaaatcaatatcacttcgcagtggtatgtgatgagacaataggcacattcatcaatgtggatgtcctaccctatgttgacgtcgtcattactagcttaacgaaggctttcagcggggcttgcaatgttatgggaggaagcgcagttttgaacataaagtctccatggtatgatttgctgaagtcgaagctcaacgaactacatgaggatctcgtgtttcctttggacgcaaaggtccttctacacaactgtctcgactttccaacccgcatacgaaaaatgaataccaacgccctagcaattgccaacttgctcaaatcctgcgagtcaattttgcagctgaaccatccttcaatggtagccactcgatccctatatgaacaataccgtcgacccagtggcggatacggggccttacttagtctcgtctttagagaccctaacagtgcgattcgtttttacgacgctattgacctacccaagggcccgagtctcggcgccaactttacgctgatcttaccttattcccagttggcacacgcttatgaactcgactgggcggagtctcacgggatagccaagcacatcataagaatcagtgctggactggaagatgagtctatcctaatatcgaaggttgatcaagctctacaagaagccttgtctcttgaaggccatagaaccatagcataa

SEQ ID NO: 278 - DNA, 1851 bp, Talaromyces cellulolyticus
atgacccattcacagcttctttcaacagcggacggtggcccagcctcgccttcccctgccaacttttggcaattgctctctcttggtgcccgccatcaggcttcaagattggctcttgtatctcgtcatcaacccccgggacacctatctaatcttttcgcgccctctaaatcatctcccggttcgtcatccgccgatgttgggttccgatgctcctacgagcaacttgtcactgccgttgagaacttggcaaccattctttatgaaaagggtgtccgcgagagtgatgtagtggcttctttcattggcaacaattacgcagtcgagtggacccttcttctgttgacatgttggaggattggagccgtttttgctccagtagagccttccctgttggcgcgaacgaaagaactgaatgaggtttacaaactgttgaaaccaaaggtcgtggtcctcggtgacgggatagacacgaagtcttgggtggtgaacgacgtgggagagaagaacgcagtcatttggctcatttgcggtggaaacgccggagcctgcagcgaaaggtggtcatcactatcacacttgacctacccggcaaattcctcatcgtctcctccaccatccgtgtcgccacctacgaatccagctctgatcatgttcacatccggcacaaccagtacgccaaagggttgttgccttacgtttgccaatatccacgccgaaattgaggggcaccacgcattcgcatatagcagctggtcgcaggcggcgaggtttctggtgaccactagtctcttccgcccattgtgctatttgggttgtctaagttcgtggatcgcgggcggcagcgtcatctttacatcccctttttttgatccagcagcatcgatagagggcttgaaggcggagcgagggacgcatctcatgatactgccgacgcagcttcgcgctctagtaaccgaatttgtgcagcagaatcactcgctcgaacacgagatcttgttcatttccccagcgggtgatgtgtccgacaaggagctcattcgtagcgctcgacaagccttgaagccgcgtcggtttgttcctcattggggcgcttcagaaggttcgccaatgtttggcttctcagttgcagataacaccttggcctcgcttccgatgttggaaagcggcgatacgggcattggtcgcgcgttgccgggaaccaaagcaaagatttgttcggccaaggaatcatctcgaacgcctgtgcctaggggggtccgaggagaacttcacgtgtcttctcctgtgctgattcatagctatctcggcaatgtgtcaagttccagtttctatgaagacgcccaggggcgctggtttcgaaccggtgattgggcggtgatggatgatgacggggtggtatacgtagtcggaaggataaaagatacaatcaagtgcagagggattggacttttccctccggtaattgaagggtatataaaggattctttcggcgtccaggcaacagtcatcggtgtacctgatgtcgactacggagagatgcccgttgctgtgttgaaatcactgccatcaacaaccacagacaaagggcatagccatctcacaaaaacggagctgagctcttcaaatcatttcccatcaaacgcaagcgaatcagctgcacaagcgattatccatggcgtcttagcccatcttggctcggagtacattctaggcgcagtttatacacttgcgcaattagagcttgctgactggccgctcaatagctcagccaagctggataagaaagtgcttcgaggcgctgttgaaagaaaatgtaaacaagatgctgttcttcgagtttcatactga

SEQ ID NO: 279 - DNA, 660 bp, Talaromyces cellulolyticus
atgtctcatcctcctaacacttccgatttacgtgttcatcattttctccggcgcgcatacgctctgaatgagagctcggaagcggaaaatctgtatgatgaatgggccgacgtctatgatgcagataatgcgaatggctacgcttctccccggcgctgcgtggaggcgattgttaacaacctctcacctagctcctcggaagcactcaagatcttcgatgccggctgcggcactggtctggtgggcgactgtttggcccagtcaacccttgcgaacaaattcgttctagatggcgtggatcttagcgtgggcatgttaggagcggcgcgcaaaaagggcgtgtatcgggaacttgaaagggcgaatctgaacgagaagattgataaggctgatgggagttatgatgttgtaacttgtgtgggaaccttgaccaagggtcacgtcggacctgaggtgttaggagaacttgcccgtgtgactgtcatgggtggattgcttgttgctacagtgcataatgacatttgggaaagtggtggctacaaagcgaaagttgaaaagttacagtctgatgggattttgcagattgtgagcacggaagaatttgggattttggactggacagagacgggaggaaggatgttagtgttgaagaagacatga

SEQ ID NO: 280 - DNA, 1977 bp, Talaromyces cellulolyticus
atgtcgggttttattattgcaagagatgctgatgatcatgaagtccgatttcagtgcgattggcaagtcaataatgcaacgatacctgcagaaaaaggcacttcctggcaaaccatcgaccttaatttcaagcgtgcttcctactccggtgaattctcatggcctgggaggatagaagacgtacgccttttcattgaattggccagcgacgagctcctccccctcgataagcaaggtcttggatctgcggaagcattcgggttgatacatgactctctctcggcggccaataatgaagacggcagtatcgccagattagtagtgccacaggaccgcggattcatcgtacgatcggacatactttcacagcgcctactggattgcccgccggtgaaaaaggtcgtcgatttttccaagccgctgcagacttttagcggagaacctatcagtattgacagtattcaagcgcttccaccagctctcgtcgcatcggttggggccatactcttgaccactcccaattcagctcgctttccaacctccgagtcgctattaagtgcccttgatcttgaattgcacaaccggctgtcctttacctggctgtcaacagagacgctgacacgtcaaacccttgtcctcctcgatggtggtcttcgcagccctgattatgggggaacgggagaaagcatatacctggcggccgaagcgctggggatcgatatggttgttctcgattaccctgggcattggctgaacgagcctcgctatcgccactggtataaggaattcatcccgttcgataccccactccacccagacgccggctatgccagtcgaatcgttgagacggtgcgatcgttgtctggtcatgtcgacggtctagtgactttgcgcgaccaatacaaggtcgctgtcgccgaggctgcccgacagctagggctatacacggagcctccctcggcgctggagatttccgcgaacaaattcaaaaccagtgtctcggcaggacatgatgtgttccaggcttccagtgctcagcaagctgtcgagctggtacgggagcacaatctcgatttccccctgatcatcaagccgtgtaacggattcctctccgaaggcgtcttccgggccgagaacgtctccgacctcgagagcggcgtccgcggcatcaataccgatcgtcatggactggagttcgtcctggaaaagtattgcgacggaccggaagtcgatgcgaatcttgtcctctgcgacggcgagctgttgttttgtgaaatatccgatgattttcccaaaagcgctgatgcaaacggccaaggcagtgtgagaacattcattgaactggcaaatgtcctcccgtccaagctgcccgaatccgagctggccatcctgcgagactcgctgcaccacgacctccttcacatgggcttccagaatgggttttaccacgtggaagcgcgggtggaaaactcaagcatggagtatgccacccaaaacaatatcctcgacttggtcgagcgcaccactccagccaaagacaaacccccttcctcctggctgatcgaagtgaatgctcggccgccgggaatacaggaatcggaagccattcgatatacgtacggggtcgactattttggtcttgcgctgttgtttggtctcaatagtcggcagcgtgtcaagcaactgtcggtccccttcttgcaaggcccgcagtattggtgcgagatggtgttcatcccggttgacaagggcggagtctttcattccgcggatgtctgcaaggaactattcgacagacatcctgatcttgccttgcacgttttttgcttcttacatcacggcgacaccgtgccggatcctggaaccggagtcaatgcttgggtggcatactttaatgtgttctcgagagagagcagggcccatgtattagaaattgccgaccgtgtaagacaagaggtcaggttttccattgtatag

SEQ ID NO: 281 - DNA, 1833 bp, Talaromyces cellulolyticus
atgacggtgagaaacgcgcggaagagcagcggctctgctttaccaggttacaaggaagacctgtccaaagggccaatgctccgcttcgaagaatccctaccaaaactccccgtcccgtctctcgaagaaaccgcagcgaaatatctcaaatccgttcagccgctcctcacgagttccgaattagcatcaactaccaaggccgtccaagatttcatccggcccgacggcgtaggtcacaagcttcaggaaaagctgattgctcgccgcaatgatccaaagatcaggaattggttatacgactggtggaatgatgcggcataccttgctttccgagattcagtgatatattccagctacttctattcgcaccgcgatgaccgaaagaggcgtattccctccaagcgcgcggcagcaatttctaccgcggtgttggagttcaagaagcaagtcgatcaaggtaccctggagcccgagtacgcaaagacgcaacccatggctatggacagctaccaatggatgttcaatgtctctagagtacccgctagaccatcggattatcccgtcaaatactcttttactgagcacaagcacattcttgtcatacgcaagaatcagttcttcaaaatactgcacgaagttgatggaaagcagctgaatactgcggaactagaacagcaatttgaacgagtctacgcaaaggcagaaaagggacctgctgtcggggccttgactacggagcaccgcgatatctggacggacgcaagagaaattttactgagagcgcacccctcgaatgcaaaagccctgaaagaggtggagtccgcttcatttgttgtatgcttggacgacgcttcacctgtgacattggaagagagggcacaccagtattggcacggtgatggggcaaaccgttggtacgacaaacctgcgcaatttattatcaacgacaatggcactgctggttttatgggtgagcatgcgatgatggacggtacctcgaccctccggctgaatgaattcgtcaacaacgccgtctttaaaaacacactcgatttctcggcctcatccgtccgctcccacctcccagatcccacactcatccatttccacgttaccaaggaggtccaagccgagattgaacgggcccaaaaggacttcaatgaagtcattgacgcccatgaactgcaagtccaagcctaccaagcctatggcaaagggttgatcaagaagctcaaatgctctcccgatgcatacgtccaaatgattattcaactggcctacttcaaaatgtacggaaagaacagacctacgtatgagtccgtcatgactcgacgcttccagcaaggacgcacggaggcctgtcgatcggtctctgtcgaatctgtggctttctgcaaagccatggccgatgattctctcgatgcaagcgagaaggccgccttgtttcacaaagccttaaaagcacacgtggcctacgttgctcaagcgtccgttggtcagggggttgatcggcatttgtttggattaaaaaggctgctggacccttatgatgaggttccggccatttatcaggatcctgcatatgcctactctagcacatggttcatttctacctcgcaactcagctcggagttcctcaacggatttggctggagccaagtcgtcgatcctgggtttggaatcgcctatatgataaacgaaaacagcattaatttcaatattgtctccaagaagctgggaagcgacaggatgagcttctacctcaacgaggctgcaggggacattcgagatcttctactctccaccctcgagcctgccaaggccaagttataa

SEQ ID NO: 282 - DNA, 1464 bp, Talaromyces cellulolyticus
atggtttccgatactcaaacccagacgggaaccagcccatcagagaaaaaggagattaacggcaccaatggccagctagatcttgaggcatcccacgttctgcacaactcgctcatctccatccctccgacggtggtatctgctgagggttcctatgtgactttcggtactggtcggcgtgtccttgatgggtgtactggtgcggccgtcgccatcatcgggcatggcaaccctgaggtgctggctgctgttcaggagcagatgtccaaggtgtcctacacgcacaccgtggcattcacaacccccgtcgccgaagccttagcgaacgaaattcttcagggaaacccacatgggctctctcgagcgttctttgtctcatccggcagcgaggctatggattccgctctcaagctcgcaagacagtactacgttgagatcggccaaccgcagcgaacccgactcgtgtcccggcagcgcgcataccatggcaacacagtcggcgcgctgagtgtgtcgagccatgtgtcaagacgggcgcctttcctggatgcgttggtcttgaataacgtgagctacgtgagcgcaacctatgcctaccgcgggcaactcgagggagaatccgaggaagagtacagcgcgaggcttgtccaggagcttgatgaacagttccagtctgtcgggcctgaaacggtcatcgccttcgtggcggagcctgtaggaggcgccacagcgggatgcatcacggccccaaagggctactaccaaggtgtccgccggctgtgtgacaggtacggcatcctgctcatcctcgacgaagtcatgtgcggtagtggccggacgggcacgtatttcgcgtttgagcaggagggcccgggcgtgtatccggacctgctcaccatgggtaaggggctgggaggaggatacgcccccatgggagccgtgttggcgcacgaaaaggtgatccgcgggctgcagagtggcagctcctactttgttcattcgcatacctatcaggcccatgccgtgggttgtgccgccgccctagccgtgcagaaagtgcttcgccgggatggccttgtcgctcgctgtgcggccaaggggcgatggttcgaggcggccctgaatgcaacaataggccagcgcaagtatgtcgggaatatccgcgggaggggcctgttctggggaatcgaatttgtccagaatcgggccactaaggagccctttccgccagcccttcgctttacgtggaagctggttgatgaggctttccgccgccacctgtcaatttatcccggggcgggcacagcggacggtttcaagggggaccatgtcatacttgcgcctccttataatgcatcagacgacgagtttgaggatcttgtgagactgttgaacgaggcctacgacgcagttgagacagaggtagacttggctcttgtggagggcaagcgtgacggcgagtaa

SEQ ID NO: 283 - DNA, 3576 bp, Talaromyces cellulolyticus
atggtattccaaaacttcaagcaaactcattctgaatgggtagagctgcagcagctcttggagtctgataagcctgtcatcattgatgggcaaagcctcaccatcaccggtgttgtggctgtagcattgtatggaaaacatgtagctgtgacagacgacccagctatcctcgaccgtgtccagcagagtgttaacattctcgactctgagctgaaaaacggtcacactgtttatggcgtgaccacaggctttggtggcagcgctgacactcgcaccagcagagtcgaaagccttcaagttgccctacagcagcatctgaatgtgggtatccttctgccgtcagacaagggcctgtactccgatacacccgtccagccagaaggtcttcaatcccatgctctgccagtgtcatttgtcaaagggatgatgattgttcgttgtaactctcttatccgcggccactctggtgtccgcctcactctgatccagaacatccttactcttctggagaaaggaatgactccagttgtgccgctacgtggcagtatttcttcatctggggatctctctactctctcctacatcgctggtatgcttgaaggtaacccggatgttttcgttcgtatcgggaacgaaaattcctccatctacctccccgccgacagggcccttcagctggcggggatccaacctatcactctacaggcaaaggaaggacttggaataaccaacggcacctctcctagctgtgctgctggttgcatcgcaatctaccaggcccagcaacttgcgcttcttacgcagctgcttactgctatgggaaccgaggcccttttaggcactgcacacaactaccatccgttcatttcagccactcggccccatcaaggccaaactgaggctgcggccaacattagtctcctgctttctgggtccaaactagcacccaacaaaaaccctgaaactatcggtctggctcaggaccgttacgccctgagaacagctcctcagtggattggaccccagcttgaagatctttgcctcgcctatcgccaagtccaggcggaagtgaactccaccacggacaatcccttgatcgatgtgcagaccggggcaattcaccatggtggtaatttccaggctgtctgtataacttccgcaatggaaaagactctgtcggcactgcaaatgctagggaagctgctgttcgctcaaagttcggagcttgtccataataaattcaacaagggactgcctcccaacctttcaagcgatgatcctagtctttcgttcacagcaaaaggctttgatgtcaatatggctgcgtacatgtcggaactcgcttacattgcacacccagtcagctcacacatacaatcggcggagatgcacaaccagtctgtcaactctcttgctctaatatctgcacgctacgccatggaagcagtagaactcgtctcactcatgtctggaacgttcatctatcttctttgccaggctcttgacctgcgatgcctacatttggaattcgtcaaggccgcggagccggccatccgtcaacttctcaagacccagtttggaaatctgatggcagacaaattgtttgacgattttgccgagcagtcctggaaggctttacttgatagatgggaaagcctgtctcacttagacctagaagatcgtgtctctgcgactattaaagagtccctaggagatatagtccattccttcatccacgacaccaatgtggaggatggttctgccgggtctcaatttttgctcgccatcgagcagtatcagagaagagcgggcacgacgctgagaaccctctacgaccgcactcgccaggagttctacaagaaccagaccacagcggactatttgagcccctcatccgccaagttgtatacctttattcggaaggaccttcaagttccgtttcaccgcggattgattgatcacccgagtacatctgcggcgattgatagcgaaagtgggcccggaaagattctgggcacacttgcgaaaatgccgattgttatggaagctccagacggactcacgtctagggaatcggccaaagcctcccccaaatatgaaccaaggctcctgccgatcactatagatgccatcgctcaaagtgatccaagtcgggtgcttgcagagttcctagaggctcctcatcactcggaggagacgtttgagttgacctttgggctttttgcccgggtaatcgatagactgtcctggtggatgagcgcgatcggcaagcaagccgaattgaagacttttgatacgattgctttggctggtttcctggactttcgtcactatgctatgctgatcctcttctgctccttagtcactgatacttctgctatggaacggctattccaagatgcagatgtcaagatctttttcaccacagtagagaaagagtctcctccggtgcaacgggcttaccctttgccaacaatcctgctccctagtgtagaggaattgataagccctggagaggtgccacgatttccttactcaaagacatatgcccaagctgctcgggatccaatcattgatttccaaagtccagggtctggttcaacagccatgcggccgcaatggacgtggaccagaacatacgccctttccgcagacgagatgtgtctgaccatcacaagccttatgcttgctggcattggggctgcagtgtttctggacgttgtcgtcgtcttccttcctttccacgtaagtggctatagcggggatcgcgctgcgtcctggcttaaaaaggctcgttgcgatgatgcgattgtgtttccaagctttctgtcactggcggtggatagtccagcactgcttgagcagctcgtcatgctgcgaaaaatattctggatcggcgctcccttgacctgggacattgctcgcctgctcgttgaccggactcatttggcgacgttatggggcacaactgaaactggctatttagtcagctttgagaccgaccccgaggactggaattatctgaatattgattcggagagagaggggatccagtgggcagaagtcaccccaaaccggttcgagatgcggttcatcaagcacgaagcacccgcggagccacaagtggcgtttttgacactgcccgatgctgatgttgttccatccggcggtctcttctcaccgcaccctaccaagcccgatcactggaagtatgcaggacggccagacaatattatagtggtcaaggacatgctgttcgacccagcaggaatagaaaaggagattgagagccttgactcagtcaagggggcgttcgtgttcgatatcaagtgtgcggtggtctgcctcatcctggagctgtacgaaactccacaggacactcagagtgcattcgaagcagtatggccgacaatccagaaagcttgcgatgggatgcccgagcaccaggtcattcagccatcccgagtcattctagcacgatcggagaagccggttcccaggaaccataagggagaagtcaaaagaccagctttggcggacttatatgaagctgaaatgagcgcttgctatagatag

SEQ ID NO: 284 - DNA, 6978 bp, Talaromyces cellulolyticus
atgatgcagcgacatcctaccgccgaggccacaaccgcgggtggctgcgtgcatcacctctttgaacatgctgttaagggctacccagacaacattgctctgatcggtggcacgcatgagctatccttccagcagcttaacacgctcgctaaccattttgccagtgctctggtcaggcgaggagtagggcgcggcgatctggtcgctatagcgctggatcgatctgtggatctggtcgtcgccttgttaggagtccttaagtcgggggcggcatacgtgcccgtagatatgggtttccctattcggcggatcaggcagatgatggatgatgcgggcccgaagtttgttatatgtcgagatagtacactggatgcactgtcatcctggagagatatatgcctgagtgttgatgacatacgaaacaacaacggcgagaaccactccttgtccggccctgatggaggcaacttggacctggacgtgtgcgccgaggatctcgcatatatcatctatacatcaggttcgactggaaagcccaagggcgtagaaatcagccatggagcggtctcaaatcttctctcgtcgatgcgacgtgaaccgggatgcgaccaaacggatcgactactagccataacaaccatttctttcgatatagccgttctagagctttttctgccactcgtctgcggcgcaaagacggtcattgcccaggcgcatcaagtccgcgacgcgggagctctaatcaaattattgaaacaccacgcaatcaccatgatgcaaggaaccccagccacctggcaattgttgctggattcgggctggcaaggcaacccccggttaggaaaagttttatgtggtggcgaggcgctttctcgtcgactggccgacaggctgctttcttgcgccgactcggtatggaacatgtacgggccaaccgaagccactgtgtgggcgagtgtttggcgggtgggccttggtggtgatgtgctcattgggaggccaatagataacatgcaattctacatactcggcgaaggcctatcgccagtgccgcaagggagtcctggtgagctgtacattggaggtgctggcgtcgcccgcggctatcatcgcaaccctgagcttactcgatctcgcttcatcgagagccctcgtcatggcggcattctgtaccaaacaggggacttagcccgttgtctggcgcccgacgagctcgtggtgctgggccgggtggatgaccaggtaaagatccggggccatcggattgagctaggcgatatcgaagcggcacttgctgcccacgaggatgtctccaaggccgtggtcgtcagtcgtgccgaccaactggtcgcctactgtgtccggaaactgcctcaggtcactgatgaggaccaggcccgcagcctggcagagtggactgccacgtgggaccatgcgtacgaaaccacagatcaagacgccgtgagccaggatgccatcctcaacctggccgggtggaggaatagctacgacggcctcccgttcagcaccaatgaaatgcgtgactggcagtcaagttccgtcagacgcatcttgtcctacggcccggaacgagtcatggagattggctcgggcaccgggatgatgcttttcagtatcgcaccgcactctagtatctactacgctatcgattcttcgagaaaagcagtcgagtttgtgcgccgtcacctggggttgttgccccatgtcacctgcgagcatcgtgaagctcacgcactgcccgtgatagagcaggagttcgacacggtcatcgtcaattctgtcatccagtatttccccagtatcgactatctagtcttgttcctcgaatgggcggttcaggcagtcggcaaaggccgtatatatcttggcgacgtgcgcaacctggcgctgctaaacgtcttccatggcgatatattgcattcccgcataaagggccaaatccccgccgttgacttagctagccgggccgcagaggcggcaaaagccgatcgtgaattggtactttcccctgatttcttcgcctctttggccaatgtcttcccgcggatatctcatgttgatatcacgttgcgcgatggtgattacgataatgaaatgaccctctatcgctttgatgtcaccttgcatattggagagcgtgacgagattggtacgaggccgagagaggtggattggcggactaaggtcgatttgtccgctctaaaggatgagctaatggatgctgcgaaaggcaacaatatgctgcgtttaaacaatgtccctaatgggaggctgcgtaatgtccacagtcgactcgggactattctcggctacccgtcatacgatagctcgtcctgggtccatccgcgtattctccatgctgtcgctcgagatgttggtatgcagtcggcacttttgcccagccggtcaaacgatgtttggagtttcgacgcggtgttttggcgggctggccagaccccagatctcacactgcaaccctccaaagcaatggacaagagcgcatgggctgaatacgcgaatgtacctaacatcggaaaagcgatcagtccggctaccctcgacagagtgctccgaccatggctagcagaccggttaccgacatatatgatgccatcgtttttcgtggtactcgacgccttgccactgacacccaatggcaagatcgaccgcaagaggctaccagatccattagtaagagacagggcaattcaaaagccagccacgcaactagaggccgatatactggccgtttggtcgcgggtgctgggccagaatggtatcgatgtcaaagataacttcttccaggtcggaggggactcgttacgtgtgactagggtgcaaaccgagttggagcaattgctcaggcggccgatcttgctcgccaaactattcgaacattacaccgtcaagacactcgcggcatacttagctgaagatatgagcaatgatgtgaaaacagacccgaaagaccatgtttctgttagccacaatgacgaagacattgctgtagtatctatggcatgccggctccctggtggagtcaccacccctgaagagttttggaagctgcttgaaagcggaggtgatgcaatcagcgaagtacccaaggctcggtgggatgcagaggctatctataatgcggatccagacgcaaagggaacatcgtactgtcgtcaaggtgggtttctcgacaccccgattgactgctatgatacagggttttttggaatttcgccccgggaagcacggtcgttggatccaatgcaatacatgatgttagagacgtgctgggaatcgtttgagcgagctgggtatacaagcgaacagctccgtggcagccagacaggagtatacgtaggggtcagtaatattccggcatactcaaaccctaacggcagcggaaaagctctagaagacctagacggatatgcagggacggggtcggctgccgcgaccatgtctgggcgtgtttcgtacacgtttgggctcgaaggtccgagcatgacggtggacacggcgtgctcatcttcgttagtcacgacccatctagcatgtactgccttgcgccaaggtgagtgtgacatggcagtgtctgctggggttagtctgatgctctcgccgggggtgcatgttgaatttagtcgactcaggggaatggcgagagacggacgatgtcgagctttcgcggccgacactgaaggcacaggatggagcgaggggtctgtggtaatggttctcaagcgcctatctgacgcccagcgagatggtgatcgcatcctggcggtggtgcgtggctcagcagttaatcatggcggacgcagcagcgcctccctcacgacgccgagcggaccggctcagaaacggctcattcggactgcgctggccgcgtctaggttgcaggcgagcgacatcgattacatagaagctcatgggacaggcactaagcttggagaccccatcgaaggggtggcactggcagaggttttcaaggacggtacccgtgaggagccgttgtgggttgggtcagccaagtccaacatcggtcatacccaagcagccgcgggtttggctgggatgttgaaggtggtgctggccatgcagcacgccattctaccgcagacgttgcatgtatcgaacaacccgacgccagcagtggagtgggagagagcaaacatggcactggtgcaggagaagcggtcgtggcggcgacgaaccgcgcggcgaaaggcaggtatcagcgcctttggtatcggtggcaccaatgcccatgtaatccttgaggagtggccgtcgcttgcaccagcggtggccaatcttgatcctcgttgtgatcctcacggtaaagatggtggtattgctacacctcctttgaaaccgctgctgctcctgtcgggccacagcaatgctgcgctgcgagcacaggccaaaaaacttttatcccatttgactaataacagtacggcgcattattctctgtacgatgtggcctactcactggcaactacacgcaatcatttccgaagacgaaaggtgctgattgcgcaggataagagggatctggcaagccagctggcaaccattgctgccgcagagtccactaacgcgccagcagaggatatggtgcagccatccagaggccaggtggccatgatattctccggtcagggtagccaatttctggatatgggcagagatcttgcacaacacttccctgtttttcgcgacgccttggaggagattactgcgcactttcatggatatttagagcggccactgttggatgtcatgtggagtggtgatgctgacagcaggaatgatgccctgctgcaaaggactgactacgcccaacccgccctgttttctttagaggtggcgctgtggcgtctgtggaccagctggggcgtgaggccagacgtgctgctaggccacagcattggtgaactggcagtagctcacgtcgccggcgtgctaaacctgagtgatgctgcccgtttggttgctgctcgtggtcggttgatgcaggcagtagatactcctggggagatggtatcgctagaagccagtgcttccgaagtgtctgcagccattgacggtttagggcttggtatgaaggtcgatattgcctgtcacaatgccccctcacaaaccgtcgcctctggtgatatagatgccgtcaaagggctacgcacccactttgccactcggggccgtaaattccattctctaagcgtctcccatgccttccattctcaccatatggaggcaatactggcggattaccgcgccgtagcagagacagttgatttcagccctcctaatatacccatcgtcagcagtctaacgggtcagagagtggctcctggccagctagagcagcctgcatactgggtacagcaggcgcgcaacgctgtccgtttcagtgatggaatacaaacccttctgatggatcacgatatcaatatcttcttggaggtagggccgcaaacggttttgtgcggcatgggtgccgcctgtgtcgatgatattcgccattccaccattgcgcctacctggttgccgtcaattattcgggaccgggacgctagctccgttattcaacagagtcttgccgaaatacacattcaacatgtgtctatcgattggtcggcttactttaaagctgccagctgtcaacgtgtcgacctgccgacctacgcttttcaacgggagcctgtgtacactataaacagggacctcaaattcaagcgtagccccacttctaaccaggtgactagcgtcgcaacagctgctgctcttcatggaacagatcctctcgatgggctgcgcagctccttgatcgtggctgctccggcagagcaactgagaatcgtattatccatgattcgagaaactgtggccaagatcttggaccatttgtcgcccgacgatgtcgacctcgacctccccttgcaagacctgggaattgattcactcactgcattgctgatgcggaaccagcttacagcgcagactggtttgaatttcccggctatggtgacactgcatcatcccaacttaagaagtctgggtcagttcctcttacaccaggcattacaggaaacgtcgtcagcttcatcacctagcagcccaaaatcttctatagcaacacctgcttcctcaggttcaccacagttgtcaccgacagcggcacaagcgatcaatggtcattctgaaccgttgcagcacaccaaaatgccttctatcgccccccttcatcgcgtcttctcccctctattgggcttgaatcctccaaatacgcctccacacctgttctcgtctgccatgagctacttcagcaattttgattggtgctcccgccttatttacgattcctcgcctacctcatcatctagtgtgctaccaggttacggacaggctattccctttatcccacaatgcttcaatcccgctagtccgcggcatgatcaatttatcggcaactggctttcaaaccacaagaaaacgatcggtagcgacaatgatacaaaacaaagtcctcctcttcgccacatgctctccctcttccgaccccgcgacccttatcacattgaagatcccttgcgccatatccctcgtgttgcttccctgtttgctctaggggagggaacgtcgggatacgagggcgttatacatgggggctttacagctacccttctcgatgagagcatcagcatagttcatgagatcaataccgcgctaggcaagacgggcaaagtcttcgccgccatcaatgtcacggcttctctcagcgtcaagttctttgctccggtagccgcgaccgaagaagtagtatgtgtgacagcgtggatagaaggcatacaagggaacaatacaacaatgaaggcggagctcacagatctcgcaggaaataagctagctgaagcagagagcgtgtttgttgccgtgaatcaaaagtga

SEQ ID NO: 285 - DNA, 3819 bp, Talaromyces cellulolyticus
atggcggacctcaaagtgcagagccgggaagccgacgaaaaacaggcaagcatcctggaccggcaattgaatggggtttccgggaccgggcagctcaagcagacctcgctgctcgcctacgcaacgacggtcgacctcatatttatcggtctcagctgtttgtctgctatcattgctggtgctctaaacccacttctcacggttatatatggacaatttgccggtaccttcgacgactttgccaacggctccgttacctccaaggaagcaacgtcgaagacggccgaattcactcttttttttgtctatctcgccattgggcaatttgttttcacgtatcttaccaccatcggcttctattacactggagagcatatcacccgtcgtttgaggaaggcatactttgaatccatcattcgacaaaacatagcgttcttcgacacaacaggtgccgggtcaattacatcacgcctgacaacagacatgaacatgatccaggagggtctaactgggaagctttccttgtgcctcagctcggcggcgacatttgggtccgcgtttgtcattgcatttgtcgtgtactggaagcttggcctcattctgtcgtccaccatcgtggcaatgaccatctcaagcaccatcggtggtgcctacgctgtcaagtacacgaagctatcgctctcgtcttccaccaaaggagccactatagcagaggaagcgatcagctccatccgccatgttacggcgtccgggatccaaaaacagctctcggaccgttatgtgccatccatattgagcgcgaggaaggaaggcatgaaggcgcggtcatctgttgcagttgtggtggcggtcttgaactcggtgccctacctgagctatgctctctccttttggatgggctcccgatttctggtcaacggctctatgaatgtttccgaaatcgtgaccatgaccctagccatcgtcattggcgcttggtcggtcggaagagtcgctcccaacgcacaagcgtttatctcgtgtatagcaagcgcaagcggcattcttaaagccatctctcgtacatcgcccctggatccttttggcgtgggtggggtggatgtcgacacgataaatggagatgttacctttgcaaatgtcgggcttgtgtacccttcccgacccgacgcgactgttttgaaggatttgagttttacgatacccctccaccaaaccacggcggtcgtaggagcatcggggtcggggaagagtagtatagtggaactgttgatgcgtttctacgagcctacgagaggccagatcttgtttgccggacatgacattcaatcaatcaacctacggtcccttcgtcgccagatctccctggtcgggcaagagcccatgcttttcaacacctcgatatttgagaatattcgttacggtcttgaaagtactgcagatgacttgagtcctgaggagactgagtccagagttattcaggcagcgaagagtgccaacgcccatggattcatatcggggcttccgttaggctacaaaacaccagtcggagaaaagggtcttcagctctccggtgggcaacgacagcgcatcgcaattgctagaggcctcatcaaaaacccaaagttgcttcttcttgatgaggccacgtctgcccttgatgtccattcggagcgagcagtccaaagtgcgctcgagaaggcagcccaaggccgcactacagtgatcattgctcaccggttgtctactattcgacatgcagataacatcattgttctagcgagcggtaacatagcagaacaaggaagtcacgaggagctgatgtcgaagaaagcatattactttcgcctcgtggaggatcagcggttattgaacacgaatgaagaagaaaagtatgttggagcgcgttcccatgaagatgacctagtagaagatacgaatgacacgctcgaggtgtctggtgtggtggaagtgaaatcagagaacacagtgacccccgacgtgacactgagagcagctagcccggccccgggtgcactgtcgtttcttgcgacccaaaagtttctcgctacaataaattcgcctagtcttgccctcctggcctttggccttgtgctttcagtaatttccggtctgggaactcctggtcagtcgatcatatttgcaaagcttatcgacgtcttgtcattacctgccagcgcctacagcaccttacggcaccgggttgacttttgggccctcatgtacctagtactcggggtggtcatactagtgatttggatatgccaaggggtcgtcctggcgtactgcgaggaaagcgctattttccgtgctaagcgccatacctttcgaagtattcttcgccaggaggttttgtttttcgaccaacgcaatcactctacaggacagttgatgtcctttctctcttccagcaccactgaccttgggggcgtcggcgggttggttcttggcactattctctcgttttgcggcaccatcggaggtggtctcatcctctccttgatcatcggttggaagttagcgctcgtgtgtacatcgaccatcccgcttgttgccggttgtggctatctacgactgatgatgctgtctctatttgatcagaaagttaaggaatcgcacaacgtgtcgatcaattatgcgagcgaggcaacgactgctatccggacagtagcttcgctttgtctcgaagaccaaattcttgtgaattacaacaggatgctgtctgagcaagccgccaagtctttgatatcaatacttcagacatctgctctatatgctgcctctcaatccatcacttttctttgtgctggcctagcattctggtatggtggaaccctggttattgatcatcagtactcaatctttcagttcttcgtctgctttgcctccttgatctccgggtctcaaacggccggtatcatcttctcccatgcacctggattcagcaaggcaatgacggcagctggagaactcaaagccctcttcgatataaaaccgaaaatagacacctgggaggcgagtggccacccagttccgaggggaaaatccgagtctcgtattaagtttgaaaatgttacttttcggtatcctgaacggccggatcgcgttgtcctgaaaaatttcaacctatcgatacgagcgggacagtacgttgcgcttgtcggacccagtgggtgtggcaagactactatcgttggactacttgaacggttttttgatccaaccgagggtcagatcaccctggacggacaggacatcacgcagctcaatgtcaatgattaccgacgaatgctctcacttgttggacaggagactacgctgtattcaggcactatcaaggaaaatctcgtgcttggcgccccagaagacatctccgaagataccatcatctcagcttgtaagaaagcaaacatatacaatttcatcgtatctcttccggatggattctcgaccgaagtcggtgcacgtggtaccatgctgagtggcggtcagcgacagcgcatcgccattgcgcgagcgctcctccgaaacactaacattctgcttcttgatgaggcgacatcttcattagattcggaatccgagaagctggtgcaggaggcattggatgtcgctgttcaacgtcgtactaccatcgccgttgcgcaccggctttcaactatccggaatgcagatctcatctgtgtgctggaccacggagtcctggtcgaatcgggaacccatagccaacttatagcgaaaagaggcgtatatttccagatggtgcagacgcagaacttggagaagactaagacgagataa

SEQ ID NO: 286 - DNA, 8220 bp, Moniliophthora roreri
atggtttcaaccccaactgccactggcttccgtcctggctatgatcacatcgatactcacgctatggccatcatcggtgtttctgtcgccgcccctggtggcgttgacgacggacttgactgtgatgagttctatgagttcctgaaggtccgtggttctggtatcattaccgtgccaaaggaccgttggaacgccgaggcataccgtgctactgagccaggtcaaccaggcaagattgccgctactaagggcggctatatacccaatttcaccatcggcgaccctcaagagtttggtattaccccggctgaatcagcccagatgtcttgctcccagattgccatgcttcaccaggccttcaacgcccttcagcgtagcggcgttgacttcagaggtactaatactggcgtctacgtcggatgcgccggcggaggtgctccctttgacatggatattactgaggctggagcgtactacatgacaggtacttctctcgcaatcaacgctaatcgtatcagctatgtcttcgacatgaccggaccgtccttgcctgttgacacggcttgctcttctagtcttaccgccatgcatctcgccgttcaggccattaggaacggcgagtgtgaccaggccgtcgtcgctggtgtcaacatcatcatgagtccgctcgagacttcttcctttagcagactcggagttcttagtccagatggtatgtctaagtctttcgatgaagatgccaacggctatgctcgtggtgacattgttggcgctctcgttatcaaacgtcacgatctcgccgtcagagatcatgatcgtatcttggctacacttgtcggaagcgctcttacttcctgtggttctcttatgggctctttgaccactcccagccctgatgctcaagcagcggccatccgaaacgcttactctgacgctggtttagttcccaaccaagccgatttcgtcgagctgcacggtaccggaaccatagttggagatcagttcgaagccaacgctgcgggcgcctgcttctcggatggtcgtggtgacagagaggtcgtcattggttccgtcaagagtaatatcggtcacggtgagatgggcgcatacatcagttcgattgttaaggcaggctcggttgtcatgatgttggagcgcaagcagattctcccgaatggatacttcaaaaagccttcttcgaagatccagtttgacaagtacaaactgcgggtacctattaaagtcgaaaactttgttccctacgacgccgagcaaggtcttattgcgtcgatttcttccttcggatttggaggatcttgtggtcacactgtcctgcgagaacacgatgttaggcccgtcctccctgactatgaaactctaaactcgggaccatatctcttcgccgttggaggtctcactcctcgtgcagtcaacattctcgtcgagagctacaaagccgagtacgcggatgtcgaccctctatccctatctgaacacctcggctctcgtgctcgccaattgagctggcgttcattcgcagttgcagattccttgggccaggcaaagttcactgaacctgtcatggtctcaaaacgtgctgttcctctgatcttttgcttctctggtcaaggccctcagcactggcaacagggtcgtgaactcttctcccgatactctgttttccgtgaaagtatcttggcttccgacaaaatttacaccgagtacacaggaaagtccttccttgaaacctccggcctctttgtccccaaccctcctgcgaactctatcctcgccaaatcgctcttttcgaccttttcgatctaccttggtctcaagcccgacgccatcgttggacacagtatcggcgaaactgctgttctttatgccagtggtgctatgcctcgcgagatggtcgtcaagatcgccgttgctcgaggtgctgctcttcgcctcgttgacaacattggtggagccatggtcgctgtctctggttgcgaccttcgaacagtccaagattatgccgaagcagtcgttgacctttccaataacccgacgacgggtgttaccgactctctccacgtggcggctcggaatagcccgaccgactttggtctctcgggtgctgagtatctcgtcgacgaactggccaagtatatcgaccaatgggtttctggggtctctgctcgcaagcttcgtgtcagcactgctgttcactctccttatgtcgatgcttgcgagacccaataccgtcaagagctcgctgcaatctttgaagcacaccctggtacccacaagccttcgcttccagtgatgtcgacagtcacagccgaattcgttgagaaggagtacacgatcgactacctctggaacaaccttcgtcaacctgttcgcttctctgatgctattcccaagctcatcgagaagtacggcgaaaacacgaccttcgttgagattgctcctcatcccgtcttgtctcaatacattaaacgaatgggtgccttcgaatcagtcgcgggtagcaaacgtcctccttcggctcgtcacatcaaagctggtcaacgccctcccaccgaacttgatgcactgtacgaagggattggtcagctgtcggttgcaggtgtcaactcgatcaactttgcactcctcaacggctgtcctccagagaagctcctcggtccgaaataccccttccaatcgaagtactttaccattgcgcctcgcgttcccagctacctccacaaattgctgcctcctgaaaggcctctcaacagcgagcggttacgtgtaagcccgagtcttccggaaacttggatggctgaccatgtcatcgatcaatcgaacctcattcctgctgccgcatacatcgaaatggccctcgagttccccgacgttacatcagtctgggattgtcggttcgagtcggcatttattctagatggatccgtgcctgcagctactctcaaggttgctcgtgatggcaacaggtggagcgtgaagtcgtctacagctctccagagtatgcaaggagatctcaactggactcgctctgaaccacccttcgattcccttcacgcttacggcaagcttgactacggtcagccagagatcagcccgggaggtatcacacacgtcgacgtcgacgctgtccttgctcgttctcggtcaacacatcttcatgaggctgtttacgatgagttggagggtgtcgcacagtttggaaccgagttccgccgaattcagaagattgctgttaacgacactgaagccattgtttggatcaaaggtcatggcaatactctcactcgtaccggctatacgttccatcccgccctgatggatgccgtcttccagtccggtatcagttggaacttgctgtacgatcatgtgaatgttggcaacaaagagcggaccttcatgttacctcactctctccgtcgtggcttccgcaacaatgggactaccgaccctgttatttttgatgatgacttccgagtctacgctgtcctcgcttactggtctccgtactcgtggactttggactgctacgtgctcgatgataacaatgacgttgtattcaccttcgaaggtctccactttgagatggtacagcaagatgatgctaccgtcaatgagcatttcagcatgatttggcagcctcgtgctctccctgaatcccatcttcacggtgatgtcaccctcgcagatgaattctctgccgaggtcgcagaacttctagaagtactggacaagctggctttgggttacacaaaaaaggcgttgagccgccttcctcaagatttccagcccactcttccggatcgcaagcggtatgtatcatgggcagcccaacgcacgtcgggctatgcactcgagtccacgatggccattgacgatgtttcacccgcaatgaaggagaaatatgcctccctttttgaactcactcagcgtgttggagaaggccagacagacattctcgtcaactccaaagctgccgttgacatcctgttccgtgacgatctcatgagccgtatttatgagcatcctcctttcattggaagcgtcttcgatgagactgtcgagcagtttgtgaagctcgttcgaactgcacaagcggctggtaaacgggtcattcgtgtattggaggttggtgctggtactggtcgattcacagctatgcttggccaagctttgctggacgcgaggcttgagctctgctatgtggactacgtctgtacagatatctcaatttcgcttgctcaagaagctactgccaagtcaccatgggccactatcgttccggtcacatttgatctcaataagcctattgaacaacaaggtattgatccggcaagcttcgacattgttgttgctttcgacgttctgcatgcaaccccgagcatcacctccacactctcgacccttcatgatttgcttctacctggcggccacctcgccatcattgaattggatggaagatcctttgcaactggcgctgttggaagtgtttggatggattacatcttcggttcattccaggaatggtttggcgttctagagcatcgtcctgcttctcattgttctttggacaagtccgagtggaacgtcgctctaaagacctcaggcttctctgatggcctcttcttgacaacatctggcaccacagtgtcgcacatggcattcttctcgcaaactgcggagatggcagtttgcaaacccagctcccccgcaatttccaccccatcacttcagagtgatagcggctcctcccctactgttgccacaccttatcttcctacatatggcttgcaggatgatcatctacaaggcatactcaccatcattgataagtactcgttgttgaaatcgctctggctgattcctctgctgcttcttctccaaagaagcaagcacaggacggaggatccagcagttgagaaacagaagccgcaaattgttctacctaccctagaggaagtccaatccctcacccttccgccgaacactgtcactcaccgcttcaccgcaggtggagaagttgaattggtcaacttggtcgctggacttgattcatccacgccgctcaaggtttggttatacaccgacaccaaagccaccaatgcaacactcattggcctgactcgatcactccgtcacgagtttgacctctggaagatctacttgatccttttccacccatcttggaccccagttaaacaagaggagttcgttcggaaggagctcattcctctccgatgggttgatgccgaagtgatggtcgaggaagatggtgccatgcgagtgccacgtgttgttgccggtcccttaccgccttctaccgaaaccgtcggctctaaacccttacacttcgatggcactcggttctggcgcactttccccaaaaccttggatgcagacgaagttcaagtcgccgtatctttcattgccctctcgagtgtgattccaggacactctgagttctctgggaaggtcgtccatgttggcgctaacgtcgacgagtcgttaactgggaagcgggtcatgggagtgacctccacccccaagggcaacttcatcatatgtcccaagggttccgtaacggtcatccccgacagcatgagtcttccgtcctctgctgctcttgttggtcggttggcgttcatctcctcggtcgtaatgaaaattttggcttctgcgaagtccagctctcacgtcatcctccatgccgctgaatcctcgcctgccgctctggctacccttgcctacctccaagagcaaggtttcaacatctttgtcacaatctccggtccctcggcacctatccctcacaaagacgttttcgaatcaggtaacgtgcaagcgtggtctcatgctgtccagagatgggcaccagagggtgccgatttcgtcttcaacttcgaagatggaaatgacatccttgaagagtccatcgagcggctttctgcttggggaaccattgtgcagatcggcggtatctacccttgtcatctccgtcctggtcaacatttcgtttctgttgggtatgaccgactcttctctggagcacagaacattttggaagaggctatccgaaccactccacgccacatcatgtcccgtctttcgccaccttttatcattgtgcaagctgatgcgttagagcttgcccattccaaggcggcgccttacagggatatgactgtccttctcaattttgaagcgttacccgagaacacgacggttctgcgacccggtagaatcaagggctcgaacgcgttcaacccatgtgccgcttatgtcattattggtggaatcggtggtcttggggtcaacattgcaaggctgttggttgaatctggggcacaacatgtcgttttgacctcgcgttcaggagagaaggcattcgagaatggcaagcttcttcgcgagaagaaaattatcaattacttgcgcgaaaccggtgctaaggttgacgtcgtcgcagtggactgtcttgacgaatcgaagactaaggctctattctccaacctaccgaatgtcgccggtgtcttctacgttgccgtgagactcaatgacgctcttttcctaaacctcactaccgaggaagactggctgaaagtgtatgatgtcaaagtcaagggcttgcgtattctcctagatgccgtcgaccccaaaaagctagacttccttgtcttgactagttctatggccacaatcagtggttctcctggtcaaagcaactatgctgcggctcaaaccgagatggaggcaatgggcgcggatattcctaactgtgttaccattactgttcctcctttgactgatggtggtgtcttcgtccgaagtatgccgactggaaacgctcgaagtgctgcgctggacaaatacaaagatctcggaatgagtggttacaagctggcgcgccactgtgtggacgcaatctggactctcaactcacctgcttataaccctgtatacatccctacgaccaattggaagcgagttatggaaattgccgttccagagtatcaccaggccagcatgcgacatcttttggtcaaggaaactagcgacggtgcaacctccaacggtgccaaggagcagtcaattctcggagcttgcgcctcggttttgtcccttgacatcgaccgagtcgaagacaacatccctttctcgacctacggtttggattcgctgacgtctgtacgtctgagtggtatcctcaggacttactttggtgtggaggttactcagttgcagctcctcagtcaaacgatgactgtcgctcggttgtatcagcttcaagaagagcagaaaacttctgctgctaccactgtcactgccaacggcccttctgagggcgagcaggccaacgttcacgaagctgatttggaccagaccgttgttcgactcaacaccgcaaccgaagggactcctctcttcctcatgcacggtgctggtggaggcatcctcgtccttgtcaaagctgcccagaaggctcattaccctgtctacggtgtgcaagacactgtggaagcacctatcaccggcaccttacgccgactctccgaattctaccttaagaaaatccaggagaagcagtcccatggtccttatcgccttggaggattctccttcggtacatgccttgcgttggatatggccgaattgttacagaagcggggtgaagttgtggaagccttagttcttctcgatggctccccgactctcttcaagcgacctgcattccaatcatacatcatgggacgaatccaagatggcactctccgcgaagatatcctcggtattgtcaacgatatggcgtcgagcggaacactcgataactccgagcacttgagctaccagttcgcagatcactttcaacattccaaagacggtggaagcggtggacccaagtggatcgctcgtttctgcactgcctatgtcgctcacgtcctaatgggtgttcgccgcggtaaagaagtcaacgcggaggaagctgcttctggggaaaggatcactggagagtggcctgcgaagaggacagtcctcgtgcgcgctttggaaggtgtatacgcccagccttgcgccgccggtgcttccgagtacttcgacctggatctttatgccccaaacgtggagaagtatgatttggctggtacacattttggtattctctctcccaagtcgggtcttgataccattctcgataacttcttctga

SEQ ID NO: 287 - DNA, 1647 bp, Moniliophthora roreri
atgcgtcgttcttcactagcctaccgtcgtgtcctccccggtgcacccacctctcgatctgctgcctcctacgctatcggctttgaaaacgctcaagagcagcgtgtccccgtcgaccttaccatccatggcacgattccgtcctggcttagtggtgtcttatatcggacaggaccaggaacctaccggattccctcaaccaataacccatcaggatccgttgacattcaacactggtttgacggactcagcatgaatcatcgcttcgagatccatcccggtggaagtcgagtatcttatcactctaggaaggcctctgaggactacgagaaacagatcatagaacacggcaaagtccccggcattgcctttggtcaacgaccagacatttgccagagcatctttcgcaagttcttcacggtctttcagcagatccgctctccaccacaacccagtacttctccgtccggtctcaatgtgcaagtcaccttgacgccagagatgcctggatggaagagcttgctccaacttgatcaccgccacacttctggtccacagtacattgtcgccaagaccgatgcagatggccttcaggtcattgatcctgtctccctcgagccactcgctacagggacctataagacattggatccacgactcgatggtcagctcagcgccgcgcattcatgccgcgacaaggagaccaacgagttcttcaattactcctgcaaggttggcggtcgttttgctacgtacaaggtgtttagaatcaatggtgatgatatagtggacgtccttgctgagatcaaagacgcgcctgcttcataccttcactcctttgctatgacctcgaagtacgtcgtccttgcggtctggcaagctcatatcactgggtatgggctgtcgatactctacaaccggaatatcgcagagtccattgacaagaaatggaatcccaatttaaagagcgtcttctacgtcattgataagaggaatggaggcattgtagcgaaatatgagactcccccgttcttctgtttccatcaactcaatgcctacgacgatcctgcgaaggacgatatcgtagtggatatgtcagtctacgatgacaacacggtaatagaccgcctctacctcgataagcttcgcaatctcacagccgagaaccccatgctcatgggacgtgctcgccgttttcgccttaatgccgtttcctcttcatccaagtccacaagaccagccatcgtcgacttcaccttttcgcaatctgaatcaatcgaacttcccactattaacccattcagctaccacaagccttaccgttacgcgtatggaatcaacaagctggatcctcgggcccatcatacgttcgcagataggatcatcaagctcgacatgcagaacatcaatcacggacataaggtctggggtatcccaggctataccccgagcgaaccgatattcgttccacgtcccgggtcagaagctgaggacgacggtgtccttcttagcgtggttctcgatggagagcgcggaaggagcatgttgattgtactgaatgcagaggatatgactgaatgtgctagggccgagatggagacaacttttcccattggattccatggcatttggacttcgacggagtga

SEQ ID NO: 288 - DNA, 1779 bp, Moniliophthora roreri
atggcatccaactggaaaccaaaacgctcgtttgaagaagtggagaaactgttatgtgcaccaggaacactgttggaaatggaacagaggttgattgctggccaagttcagcgcgtctacaaaaacttatggccatctgtccgactattctttctctccgtcaccgccctacatgcggacaagatcaatgtggtgtttgagaacgaacgtctgacttttcaggagatgaatgagcgtgccactcgagcggcagcgattcttcgcgatgtctatggtgtattgaagggtgaccgtgtagccatttgctctcgcaactttcctgaatacctggtcgtcttttgggctatccatctccttggagctgtaccagtattagtgaacgcttggttaccaagcgaacctctagagcattgtctgacgcgggcgcggcccaaactcatattcttggatccagaaagagcaaagatcgtgcaacctatggtgccaaaattgtccaaaataggcgtgaaagcatatatcgttttgcaaagtcacgaagggaaaggacagtggccaggcatgcagacttgggaggccgttacgaagagctataggggagacgcttcaaccgttctgacccaagaccccggtatcctccccgaagataactgcattattatcttcacctcagggtcgacgggacttccaaagggcgtccttttgagtcagcgggcgtttgttactgctatcggcaatgccctcgctggacgaggtcgtgccttactccgtaagggagaatcattccctccgcccccggcagaaggtcctcagccgggattgttactaccaacaccgttcttccatgttaccggtacaaccttgactttatttgctgctgtcggcggagccaaactcgttctaatgcgcaagtgggatgtgaaagaagccgtcagactattcaaagcggagaacatcacagctgctggcggtgtaccctcaacagtagttgacttgctcgacaacggaggatctggacatccactagatggcgtgatgcttggaggtgcagccgtctcgtcgacgatagctgcgcgagccaaggcagcgttccctggttccacattatcacaggcttatggtcagacagagtgcaatgcgactgctgttggattctctggagaggactatgagacccggctcagttcatgcggacgcgctatgcctgtcaacgatctgttaatcatgaaagacgatgtagagtgcaagctgggtgaaccaggtgaagtctggattcggggaccgaacgttatgaaggaatattggggcgatccagtcgccacagcaaaggtcctcacgaaagatggctgggtgaaaactggtgacatcggatacatggatgaagaagggttcctttacatcaaagaccggttgaaagatatcatcattcgtggaggtgaaaatgtcgactctgtgatggttgagaacgctttatatagggatcctcggatctttgaagcagctgctgtcggggtccctgacagacgactaggcgaattggtcgctgccctcgtcacgttgaaatctgcgtatagaggcaaaggacaggttacagaagccgagctgctggctttagctcggaaacatttacctaggttcgcagtacccgtgatgattttgattcgggaaggagattttgagcacaccccgtctgagaagatcatcaagatgcaactacgaaagattgccgctgaagagtgggagaaacgcaaggcttctgaaaacggacaggccaaattgtag

SEQ ID NO: 289 - DNA, 1591 bp, Moniliophthora roreri
atgtcgaccagggaaaaacaaaacagcgcggacacagttctcgagaatgacgaggctgaattggcgaggatgggttacaagcaggagttgaagagggacttggggttattacagaattttggaatgtccttctcaatcatatcggtcatgactggaataccatcccttttcgcatatggactcaataccggaggaccggcagtgatggtatggggatggatcatagtttccgtgtttacaatgcttgtgggcctggccatggcagaggtttgcagtgcccacccgacttccggaggaccctacttttgggctgctatgttatcgagtcctgaagacgcaccactgctatcatggataacggggtggttcaacttgttgggacaagtcgctgtcaccactggaatcagctttggttgcgctagcttcatatcaacaatctgcacattcaacacagatttcgagcctacaccaaacactcaaattggtatatacgccgccgtactcgtcagccaaggcctcataaatacctttggagtccacctcctacatcacctcaacaacatctcagtctggtggcatgctgctgggacattctcagtagtagtcgccatactagccaaagcacccacccatcaatcggcgcatttcgtctttcagacattcctggatggtaccggtggatgggcagaaagagctagcccagcttatgtagccgtcatcgggattcttatggcacagtatacgcttaccggattcgatgctagcgctcatatgaccgaagagacacgcaatgccgccatgtcgggaagtcttggcattattatggccattggcgtttctgcgctgctaggatggtatctcatcctgggattgctgttttcgattcaaaatttggaccgaacactcgattctccaagtggacaaccggtcgctcagatattcatcgataccgttggcgtgaatggcgcaattgcacttatggtagtggttattggatgcatgtacttttgcgggacattctcaataacgtcaaactctcgcatgatgtacgcctttgcgagagatggtggcattcctggctcccaattctttgcctatgttaacacgaaatggaagtcgccgatacgaacggtctggcttgcctgcactctgagtttcatcctcgggttgcccagcttaggtagcactgttgcattctcagcggcaacatcgatcgccactattggattgtacacctcatacggcatacctatcgcattacgaatcgtctaccaccagaaatttgtcaaaggacccttccatctacacaagttctccttccccgtcgctatcacagctgttctgtggatcgcgtttatctcgatcgtctttattctaccacaagtcaaccctgtcgattcgcagacgctcaactattcgattgtcgctgttggcatcgtcatcatatatagcgtagggttttggttgttgagtgctagaaagtggtttactggacctgtcaagcagattgctgctgaggagatgggtattaatgttatggagccaggaacagcagagaaagttgaagagatggagagggagaaggctcgta

SEQ ID NO: 290 - DNA, 8360 bp, Hypholoma sublateritium
atggctttgaagcccattgcaattgtgagaatctgctctctgatgtactgtgattggcgcagatttataatgtcttcaatttaggttggaatatcggctgaatttccaagcggagcctacagcactcaaaatttgaactatgacgatttttcaaaatttcttctcagcaaaggagaatcctacgagaaagtcccaaaggatcgttttgatatcgagcggtgagtagaggagctggcgacatatttccacacctcttattctgatgcaacttacagctggcatggccagggtcttggtcgtaccattacccagaaagggtctttcctcaaggatgttaccctcttcgatcatgtggaatttgggattacctcaaaggatgctaagaatatgtcgcttgggacgcgcaaacttgttgaacatgcatttcttgctctcctagactctggaatcaactatcgcggaaggaacgtcggatgttacatgtccgcgacagcatttgacatacatggtgtgtcggagcctgtaagtttcttcttggatactgtaatggttttgactgatatctgtttacgtactaggatgagttagaggccattggatcattctctggatatcccaacgctgttgcaaataaagtctcgtaccatctggatttgagaggaccgtcgataccaacggacacggcttgtagctcatctctttctgctctccatctcgccgtccaggccattcgatctggtgactgctcggccgcagtaataggtggatgtcagcttaacttccggtatgaaggcagtacttctttaactctcttcttccaaactgacttgctaccagacttatagacttcatcttgtatagtcaagggtcgattctttctgcagatggaaaatgcaagccactggatgagtcggcaaacgggtatgtcttttgacgggccaccctatactatcttctgatcttccccatagattttcacgcggagagggcgcaacggttatcgtcctgaaattgctggaagaggcgattcgagataatgactatatatatggctctgtaagaatccttgtcataagtgtcatcaaattatttatttaaatgtgggttttattagatactaggtacaggcatcaattcgtctggttctcttgcacccaccagcgctccggttgcatcggcgcagcaggaggcaatgaaaagggcgttcaaggacaccggccgcaccccgtcggaggtagattatgtcgagctgcatgccactggtagggttacttcgattctataaaggtgtaatattaatttaagattattgttacttcagggacatctgcaggcgatcctgtcgaagccaactgggttggccaggtgtttggtcagcgtgactccgagctcttggtaggaagcgtgaaaggaaatatcgggtgagtctgaaggtcaaatatttttcagaatttatgactcacatactcaatcccttcagacacttagagatatgtgcattcctagcatctctctgcaaggtctgcgcgatgttccagaccaggctattgccaccaaccgtgaacttatcaaagccgaatccagccattgcatggggtcgctggaatatgcgtgcccctaccgaggtcttgtccattgcaggaggtaaaaaccagcttctagtgtcaattgcaagttcaggaattggtggagccaacggtcatgccctcgtagaatccttctcaccagcacagccgttacaaatctctcagccagctcacgaacaccctttattgatcatgactggcggattatctcctaggagtgcaactgaaatgggaaattctatcgattctgcatggaaagatagttctttaggggacctaccagtgttatcgtcaatctggagtagacgtggtcgccagatgccttggcagacattctcgatcaagtcgaactacgccagtgtcgttccctttgcaaaaccgacactccttccgaagtctattcctggcctagtttttgtattttcagggcaaggcccacaatatatcctcagtgagttcagctatataatatgcagacatgcacatatttattcgggatacaaatcagtgggaagtcagctttttgaaagttacccagcattccgaaacagcattcttggaatggatgttgtatacgaaaagatagttggtcattcgataagatctcttggactcttttcgagtggctcgactgacaagtggggaatttggcccatcaccgtcaccttgcctgcgatcgcgatggtgcaaatggcgatatacgacctcctttccagtatcggaatcgttcccagagccgtcgttggtcattctgcaggagaaacagcaatgatgtatgcctctggtgcttgttcgagagatatggccctcgagatttccattgcacgtagtagagcgctcgggactttggaatgtttgggcggctcgatggtggcgttgggctgcgggccggatgaggctcaggcaatcattgatgacgtgctggccaaccaaacaggtatcctccaaatcgcgtgccacaattcggactctgctgttactgtctccggcgctgagccactcttggactctgttgtcgccctcgcaaaatcccgggacatatccgcacacaaactccgcaccaaagttgctgtgcattccgacttcgtcgaacagtgcaaagccacatattaccagcaggtggaggacatattcactcgttatccgggacatcatgtacctttggtttcaacatactcttcgaccttcggtacaatctggtcaggacccttcactcctgattactactggtgcaatgctcgccagccagtgttgttcagccaggctatcaacatgataatcaaagaccacccggaagttggcttcgtagagatttctccccatccagtgctttctacatacatatgcgacgcaggagtcgagcaagaacgtgtactgtgcttcatgaggcgcactagggatcctcatccatcctcggagcctatcatgtttctacgagggattgccaagctctctctccttgggtataccgacatagattttcactcgttgaacaacactcgggcttcctccaaagataggtctatttcttacccattccagcggaaatatgttccgttccgtcctgaaccgccaaaatctacgatgtatgcccgctcaaacgaatggtccggacctctactccacacgggtctccgtttgaatgctgcaactcaccccaagttagctgagcatgtcattatgggcgaacctatattacctgcggcgggatttcttgagatggtaaaatttcactctgaattttacaggtttccttgctaatatccctccaaaaaggtcttcgaatctggcgcccaactagcatggaacattcgattccactctatgctttctctttctagcgagcgaccgttgcctgtatcgttcactgtaaatgggccttcctggtccgttagctcagagttgcaatctcatccttactcagtgcgtcgggagagtttttatttgaaataattactgacatgttacgagaagaagaaacgaattcatgccgaaggatacatgtcctcgacggcagttttggattctcgtaaactttccatcagtgatctaaaaagaaacctgcaacaggtcgatatatcgggttcgtgtgtttgtgttcttgtagtaagtatgttctcacatatctttccaggtctttatagtgtcttgaatcatttctcccgatacggaccagtcttccaacgagttaacgcatgctggaggtccaacacggaggcccttgttgaaatccgtgcatatgatgcagatcttgaagagtgagatacattcaccgctctaagcaacgtagttcatcactcaatatccatattccagcctcgataaatatgtcattcacccagctcttttggacgcatgtttccatatcgtcgttcaccccatgtttacagcaaatgcagatcgatcagtgtactacctccctacatctgtggaaacggttacggtgcacgatccctggttcatacgacaaacccttcctaagattgtgtatagtcatgtagcgtacaaatcatgggacccaggtgagcgtctactactactgttggaagatttcagcccctgaacaatttaacagcgggcatcactttcgacctatcagtagctgatgctagtggtaacataatttgccaactattaggttttcgaattgccaagcacaaaaaaacatccaccgttgaatttgaacatcaagtacaattcgatagccgatacgaaatcgtttatcaacctctcctgacgtctacaccatacacactttcgcaacccaaagtcgtggctctccctgtacaattccagtcaaatcatgcgatcgcttccatggtacgtctttgtgtaatgcgagcctcattgaatctaataaaaccttaggagctccaaagtaccgatggaaagaagccaatagattcggtggagaatattctcagattcctccgaactcaggtcggattgagcgtcattcgcgtgttgagcgttggatccggtaaatatcaaagcaattatatatcatataagattatgacccctttcatcatcagaaccacttaaattgttacgtgcattgacagaatcaaattttctctaccagtctatcctccatcttgacgtccttgtcaagcgggagtctctaactgaagtaccgttgaaaggagtcggaaggattatacagtccgtccacgcccaggaagggaggaacggcaatgacacttctttctacgatgttgtactggtacacgaagatgggtccgataccgctgccctgcaacacatcgttcaaagactacttcccggaggctttcttatattgaccaccgacgatgtcgatttggacgcctcattaacggcgacggactgctcaccaaattctcatgtcatatttcagaataagctcaccaccgggcttctgacagcatgcactgctgctgtttcctcgggtcaagtgaaagcatcagacgcattctcgacatgcgaagagccggtgcgggtcatagggcaggaactttctccgacgaaaacaatcatcaagtcattcccattcaacgatgtcttatcccttcagcaaacaatccaagcgctttctgaaaacgagacgctatggatagaatctccacaagatgcgaacgggtatgccgccactggattagtgagatccctgcagcacgagatggtcaccaaggacattcgtctagccttgttcgatgtcaaatggtccccagaagaaagaactgcaatggtgtcatcattctcttcctatccctacatcgaaaaggaagttctcgttgactctttcggtgtgatacgcgttccacggctggtcccgtcttcgatacttgtcactggtacaagctggtatgatcaagcgaggaattccactggccgcaacattggggatggacccgcctcacacccctccccagtcttcaaatatcggctgtcaccatcccatgcgcaagttcatgtgatcagttcgtcgtctgagtgcgtaggccacaaggcggttatcggatacgtcctggacgctggcactacgacttgggcacagggcacatacgtggtatgcaccacgcgggacctcatcgcgaatgctgaatctgtcgccgtccacgaacactcgttgttggagtatacacatttcggttcacattctccttcggccatatcaggtggtgccatgaccgtctttattgctgctcttgcaattggctccaggacacttgcccgccccgacgccttgggcaaccttcgagtatcagtcacacgaaacggcccagaagacgaaatcagtctgtcattgagtgcgcttctgaccctactcggcatcacggttaccactatctcgaaacccataactccagaggtcctgagcggcattcgttcgtcagacgtcgtactcacagggtggtccaacccaagtgatatagagaccataaccagcttgctcccagagtcagcgacgttcctttcttggaatgctccccaagcagatgttgttaaccttctgaaacgaaatacatggatggttggcgacattctacacggcacccgcgatatcttacaccactttttgagtcaccaagagtcgcagacggaagacggaattgcccctgtggaatcgcagaccaaaagtcaaccaacatcgacctccgattctttgtttgacgcgtcaaaggagtattacctgattggcggtataggatcattaggagtccgagcggcattgtggatgtacgaggtcagttggatatgaaattcacgacatgttcattccactcatcggctactttcagaacggtgcacggatgctggtccttacttcgcgacgtggagattcttcgtctcttgccaagtcaggagatgaaatggcaattcggatgctcttatatctacagaaccgcatggatctccgcataagattggaagcgtgcgacgctagttctgttcctgagatgactgcacttttccgtcgagcagatgcgccaatcggtggcgccattctcgcctccgtggttctggcagacaagttgttcgttgcgtatgacaagtcgagctactgtgctccgtttccgggaaaaattggcgcgttggtggcactcgagcgcgccattgacatcaagtcccttgatttcttggtctcgatctcctccgtgtctgccctcggaaacgtggggcaaaccaactatgccaggtaactcattcgttccattgtcaccttacgcggcgctaataagccccattagcgctaatactgcagtcgacggcttgctttcaaagtatacgaatgccttttccataatgtctcctgcgatcatcgacagtactattatgtcgaccggccttgacttgtcgccggacccacgatacaagggctggctggaatgtgcaatgacttgctccggtacgtcggattactggaatgttaacagcgtatgacagagtctaattgacgacgtcaatgtagaactcctcgagtgtgtaggtgacgggattcgtgtcatagcaaacaaacgaatgtctctatacgtccctcgattgaactggtattatatgaagaagcatctagggccatctcctatatacaaccatctcgtttacgagcctacgcaaaacaaagaagaggcatccaccaatagcgcagacgtgctgatacccgccatcatcatgaagctgttggacattgagcaggatgatttttcacccgacatcccgctcacctcgtacggcctagactccctgtcagccggacgtctctcgcactccctgaaaccattcctccaaatttcccagcttcagctccttgcagacgttagccttgaagatattcaaaggcgtattgaggacaacaagaaggctaatgtccccaccgaagtaccagaaacagctcagaatagcgattttgactgggccgcactcaaccagccggggcagacactggtcaagttggtcggcggagacggcgtcccgctcatcgttgtccacggcgtgaacggaaacatcgtccctttcattccgctgcaagagcagttcacaacgccgctgtgggcaatacaactcacaccagactgtcctactgactcgatgcaagccctggccgctttctacttgatgcaaatcaagacagcacgcccctctgggccataccgaattggggggtattccgcaggcacccttttggcgtttgaaatagcgtaccttttgcatgcctctggtgaccaagtcttacagatggtggtttttgacttcttccccacgatcttgaccgctcctcatttccagccggaccacgagacgatcgagacaaggaaagccagtcacgctatgcaaaccacattgattgagttgctcctcggcacctactcgcgggagtcaaaggtctcgcaccagcgcattgccactgagctcaagggcgcatgggctggcgaagaggtgccgcagctcgcgcaagactacgtggcgggcgtaagcaagatggccacgatgttcgcaaaattcttgatcgatctttgctttattgagcgcgcggaccaggtcccctcccaggagatttatcgcattctccgcgagtggagtatgagagtcgaccttccactcgtcatcgcgatcgcagaacatgggttgttcgagtcgctgcctgagccaaccgaccagtggaccaatctggcgtggacgggggccagtatcatcaatttgccgtcctgcggccattacagtatgctggagtccccggtccttgttgatgcattgcaagatggatggcgcgcaaaggaagaaagcccgtag

SEQ ID NO: 291 - DNA, 1426 bp, Hypholoma sublateritium
tcaaacaatctgtttggaagatttgctcgagctgtcgtagtcgtgatcgttactgacggcatgttcgatgtttattgccaggggacgcaggggataattatttgtcttgaaaggagtgcgatctcttccaccaacaatggcgttctgtgatccgctgtttgcactgttcacgctagcgacggttgattgctgagcccatccaagacctacgcggacatttattagcatgaaagagattcccgacatggctgacaagcaatcgatgccaatgaattgaagattcgactgggattgataagtggcaaaaaagaatgttgtccacgctctattgtattcgtgagttggtccttcgcagtatcctttctatgacacttacgtataaacgaaggcgctttcgacaataattccaagaatactcttgaataaaaagtcccagatcagctcattggtccaaattattaagtatcttttgcgtacggatagatttcgagatcctatggaacggacagacctgtttatcctccatatcctccacgaaattcccactatacatatctgagtaaacaattaaatgtaacacaactgactatcaagccttaccgctgctatacagattcgtgctaataagggaatatcgattatggattagaggctgattacaggacaaatttaagatgacttaccaaagggtgaacacggtatcgctcgttatccagcgcccagcttcagacaagaaaactggctgccccggctggtacatgctaaattgaaccgtgattccagttccacaaactttcgacggtgaatgtgaacagactccttcatatatgaacatacatactcacttgcaagtccgataaatgaacaaattggaaatataatgattgccttgttatacccccacacaacccacaaccgatatatctatgtatagaattcaatttcaagttatgccactagcatttgaggttgaaaactagaggactcacaatcattgcatcacctgctagtaaacttactatcagaaaaccagtttttgctacttcggtttcttgacttagatctgcaaaaaaggccagcggtgcatctcctgagggagagttgacgaacgccttgaatagccttacgcaatctatcagccaatgctgccaattgaaataagcctcatttcgtgaatcaagaaaatcggaacgacacttactgctgttacagatatgaacagaacgaaagaggacacaatgagtgggtttctcaaagttgacgacagcttttggccgtttccgtgtgctctttcaacttccgtgagcttgtgggtcgacaagaggtatgtggaaaatacaaagagaaccagaaatatgccataaagacagctttcgacacagatagtggccagactaactgaaacgagaggaatgttaggcgtcat

SEQ ID NO: 292 - DNA, 4076 bp, Hypholoma sublateritium
ttacataaaacctacagcacgccagtatgagacccacaatttcgcatccaccccgctcagctgctccgaattagccaacgtgggggaggctttcacggcgttctccgtagaaagacgtggaagcccaaaagcctcgcatgcgttctcgactgtcccatcggccttaagccccaggctcctgtagaaattgagcagtcgcaaagccgcaactgaattaaggctcgtatctgtatcttctttctgagcgagcgctaaatgttctaacttggataaccattcgtgataagggacgagaggaacagagagctcggttgatagcgcctttgccagcgtcggccatggagtcggagtgggatgaacaagatgaacaatccctgattctggagcgttcattatgtcgaccaagcttcgaccagcgacgtgaactggaagccaagatatatcctgtgccaaccatatagatatcaataatcacataaagaagcggtgttatttaaaatacctttccgacattcgggaggcaggagacgaattttgcactctgaactaaagctggaagccattctttggtgctccaaaatccgttcggtccaccgctgatctggcccacacgaacgatgacggttttgagaggggtggttgacgatgcggccctcagtacctgctccgaaacccacttcgattccgtatatcctgtcccaatagccacttgggcttcaataggcaactctgggagattttcgacagtagagattgggttttggaaaacaccaatagtactggtgaagatcgcagtaggagggcggggaagcggggaagaaagagagaagtcaatgaggctacgcagtccccgaacgtttgcctcaaatgatgtgagtgataggttgaaatccacaggccaagctgactccaacaaatgaatggtgatttgaagcgaagaattatattatgacctaccgttatgtatgatgtgcgtgacggacttttgcatcttcaaaatggtgttattttatgtgtttggaggaataatcaaagtcgttacgtaccatatcgtaaactgttcgttccagcgaccagtatggctcatccaatcttccttccaacaaagttatcttgggggattccaatatgcttagcggaagcgctttatcaagtaaagaagttcgctggcggtcgagcagggtggcagatccgtccttcgatggtcggttaatgcagtacacgcgttcaacaccgtcatccgcaacaagagcgctgaggatgaacgttccgagcccccctgttgaaccggtgagaagcacaatcttgtgatcgggaaatgggctggtcccaggattgtgtcctggaaaattggccgagtacttggcggccatatcttccatacctttctgcctgacgtcatccgcagattggtgggtctggttaccagagatgtgggcgaccagaaacgtagcaagcgccgatatggtagggtagtcgtacacaaagttgttggcattccttcgggtatccaattggatactatcgcgcagcgcacgcgtgagcgtattcctgatccatgtcgcttgaaggctgtaataaggcatagactgagaaaagcgtctgggtgagtattggatgacatacctgtcacacccatgctggaaaatgtcatcgtcgtctttgacctggtgtactaagacaccgccgacgacagctctaacaaaattggtggcagagacaatgtcccactccttcgggagagggatgctcgtttgcgtagtgcgatccacggcgtcatacacagcctccacctcgtctacgtaatttttgagaatggcctgacggcgcgcggtgttctttgccgtatattcgaatggtttgctaggctttgcaacaacaatcatctccttaaataaccgagaatgctggggggcgaactgattcatcttctggatcgtcggcctgtttcggctcagtacataccctaattcgcactgaagagtgactacgtaccatatcttgtttctaaagctctcgagcgcggtatcgtcagacggatcgaatttgaaggcaggcttggggtctatgagaactccggcttggaattttccacgcccaaacatcacagaagattggacgtgagggtcttgattgaggatattttcttcgtaaaaaccattagttgggcttgggttatttttttttaaaaaaaaacacataccgagagggcctggattcgtctaataacatttaaaggaaacatttattagcggcaacaaatggttacacaagtccgaactaccttctctccggtgttgtgcataatctgatcgtcggttctgccaaacactttccaataaccaggtttcgtcgggtgcgccatcaagaggtcagatgtagcataggcatcgactccgtttacttgggtgtttatcactgacggatggcaatattcattcgcctgttatgaagtgtcatgcgagcgtcgcatctccccgaattgtggacttacgaccataacgaattcgtaggtgttctcatgatatagaaccatttcagctttcaccaagcccgggaacttgaaatattcccagtcatacccaggcgacgctgtttatatatcagtgtacttgttcctgtgttaatggtatttctaaatagcagtacctggaagtataggactcatcaccccgccctcagttctacaaaaataagatttcaaggactcgtaaattgcaaagtaacttacgctccgtagagaacaaaaatggaaaccccttgggaggtcatataatctccggcagccttgttcaatggcccaccaccgtacagctttgagggtttcaatgagtgtcaaggattttgtatcttatatacttccatgcttacaacacctctacgggtagcgagccattttacgtacaccggattccgagaccacgcctaacaaagtgatcaggcaactggaagagcattgcagccggagttagacacatacttcaatgattgctggtacgcagaagattatatcactttgcgtggccacagccgcgtgaaataagttgtccggggttggtatttgtgcaggagactttggttcaaatgcactgagtactacgccgcacgccgcctatgatcaagttgaaaaatacgtaaagaaaaatattgtatagatttgataaatagcgtaccgtccaggagcattgcataacgcccattccgtgatacatgggcatagtgtgaagcgataatacctggtctgtcaaatcatgctctccgaagtatgggataatacccaattcgagaaagcggaagtttgtaaacggaattggctttggaaacgcggttgaacctggattgaggtcttttattagaatatatattaggttcaagtgctagtacatacctgaggaatggagatatgcgattatatgattgggttcctttggaacggatggaagtgtttcgaaattgtcgcgagcatcacgataaaggtcctcgaaacaaggcatagcaatcaacttcgggtagactacttgcgtactgtaattgtccttcaaggcctgaagagactcatttgccaagtctgtcatagatatctcattcccgacgagaatatagcgaacgccgacagatttgatgaggtgggcaatagcaggtggcgaattacgcggagagatcgggaaaaccgtgcagccactgcgtatgactgccatgatcatggtgaagtacgttatagtatctgtgagtaacccggattttatattaattgtgaccacaaaatcgaggggttaaagggtaccggttgctccaagaattgcaacaatgggagggacgtctgactctgctttccagtcgacgttgtgctgcaaaaatttgacaccgttgtagatggcccgtacggcttccggccagtatattgtcctgatatcattattgttgtcagcaaatatgaaaagtcggtgagacgggttatgtttataattccagtcgtatatctctggaagcgtaagggaaccatccaaaggaggaggctgaaaggttttcgactgtagaacttgactctgcggaggagtcggtattttggcgaacat

SEQ ID NO: 293 - DNA, 1649 bp, Hypholoma sublateritium
ctacttgtcaatcttaggcacacggcgcacatagacgtctttgaatgcactctccgcctgcccctcgggcttgacaaacccagccgcgcgcttctcctccgccagcacgcgcacaacgcccaggagatcgtccacggccgcctccgaagtctggatgtgcaccaccaggcgcgagcccccgaggaaaagcggctccggcagcgcagaaccgcggttgccgatctcgtcaaaggtgaccccgatgggggtggggtcgtagaagatctaccacgtatataaacgttatttcatgtcctggtagagaaagtattggctgcttaccatgcaggtctccgcgcggctgaggatcgcgcagccgatctcctcgaggcccgcctcgagccgccgtgcaagcgcgtgtacgcgcgggagctgcggaaagttgtgcgtcaatgcgtacgcgcccgccgctgcgaggatgcctgtctggcgcatgccgccgccaaaaagcttgcggaaccggcgtgctttcgcgatgaactcctttgtgccaacgaggaccgagccaaccggggcgcctgtattcgcatgcggtttcagagaatgagatttgagagaggtagcggggacagcgtacctaggcccttgctaaggcacaggctgacggagtcgaagggcgcacaaagttcgctcaacggcatttctgtctcggcagcgacatgccatatccgggcgccgtcaaggtgcatcttgaccccgacagagtgcgcgtattccgagatagcgatgacttcctcctgcgggattatcgtcccgttgagcgtgttctcgagagcaacgatctcagtcggtgcgctggtactgtgcgtgagcgtatgcgcctggcgtggaaacgtgcagcgtacaagtgaccgtcgtcgctgatgatgatgttgtccttaacatcctgcagcgtcagatggtgctctgcgtggattcatgattatttattttgttctgagaatacacagctttctcactgttagacggaatcacgggaatcacggctgcgcccgagtggaaggccgcgcctccagcttcgtatctgatagcccagtcagcaaaatgtattcaaacagaacaaagaaatatgaagttcacttgtgaatgtgagcgcgatggtcgcatatgatggaatatggcggttgcttcaagtgtgtgcggaggccgatttgattcgacgcggttcccgatgggaggtagagcccggcctccttgcccgttattttggcgatatgggcttccagagccctgtatgattggcatattcccctagtcaggcgtagattttccgggtaggtcaaacgactgacgcagaggacggctcaaagtacacatcgtcgccgagtgtcgcgagcgttgcatacgcgtacatatcctcagtgggcactgatcacgggaaacctaactcagccacactcgcatttcagataggcgctcgagatcaacctgtcactgtgtccgctgcacgccacccggtaagagatcggagcgtaagtagggcagtgttgcttacatatgaacgttcgggcgatctccttgcgcttcttggcgttctccaacgcatgcgtctccgagaggatgtcaaacttgaccgtgtcagcgatactggagaaagcggcggtggccat

SEQ ID NO: 294 - DNA, 909 bp, Ceriporiopsis subvermispora
atgcgtatcattgttacaggtgcatctggactccttggctcccagatatatgctgcattcaagaatacggaacatacggttctgggccttgcgcactcacgcgcgacaggagagctgcagaagctagatctcttggatagcaaggaggtcgagaaggtcttcgcagatttcaacccggaatgggtgatacactgtgcggcggagcgcaggccagatgtagcggagaagaaccccgacgggacgcggaaacttaacgtcgaaatcccccttcaccttgcacaattgtccaagtccctcaagtatacgctaatctacatctctaccgactatgtgttcgatggaacctcaccaccctacacccctggtgcactcacgaaccctgtcaacctctacggccagacgaagcgcgacggtgagctcgctgtcctcggcgtatctgacgcgcgtgcggtcgtcctgcgtgtgcctgtgctctacgggcctacgcccaacaatactgactcggcggtgaacatccttctggacatcgtcgcggaccagtcgggcaagacatacaagatggaccactacgcaacgcgcttcccgacgggcgtcgtcgacatcgcggatttcctcgtgaggctggctacactcccgccgtcccgacagatcccaccgatcctgcactactctgcgagtgagccgttcaccaagtacgagatgtgcctcatcttcgcgcgtatccttggtgtgccgcattcgcacatcattcccgacgcagaggctcccaagggtgatgcagcaacgtcgcgccctcgcgattgtcagctgtatacccgcgaaacggaagacctgatggagggatacggcggtctcggctggacgccattcgaggagtggtgggtcgactatctaaacaagaggcagtga

SEQ ID NO: 295 - DNA, 1899 bp, Ceriporiopsis subvermispora
atgtctgcgactgcaggcatctcacaggtcgctctgggaggctcagtgcccccactcactgctcatgctatctctgtatctctgccgacatggaatgacaacgttgggtatgagaagggcgagaagagggtcgtggatgcgatggtcactggctacccgcgtttcttcatccatcgcagtattcaaaagctagctcgtatctgcgagcagaagtttggcgcgaacggtgaacgatgcctgctgtgtccgactcgcaaagttgcagaggcgtgccgctcctacatgatcgatagatctgcgaaggctggctcacaggtcactgtgcgcctcgttcaattcttcataagccccgagggcgagaaagattgcaccaaccgtagcatcgaactccatattgccctgttcccgggcgagtccttcccgtttgccaaagaattttggcagcacacaggtttgtgcatctcgagccgtcgtgctgagcgctgcttgtctatgttgccggaggagagtcccgtctcgggatctccgacgtccccatctctcgctcgcccgcccaccaagcctggaaatagacactactctaacaagagtctcagctggactccctcgacatcacctccattgtcacagccgccaggctccacttccagatcccccgcagcgcctggagagaacctcagtttcgatcagaccacttacgtcgaggaacgctacggtcgcaacttacccctcgagtccgctgcgttcacaaaacgtgcactccgccgccgcatagcaggtgtgctcgtccgagacacccctagtgagtggtctactgcaggagcgcaagaggcagaagttggtccaagcacgagaggcgtggaaagtgtcacagaagacgatgtcttcctctacccgaccggtatgtcggcgatctggagtgctcatcagctggcccttggtacacgtccaactgcaaagagtatctgctttggattcccatatactgatactctcaagattctagagaagtggggacctggctgtcacttcttgggctatggcctcgattcggacatagacgaactggaggagatcctcaggcgagaatctgcagatacgactcatccgcctgcattggcgctcttcactgagttcccttccaacccgttgctgcgctcggcggatctgccacgtctccgcgccctggcagacaaatatgacttcctcatcgtcgttgacgagacgattggcaactttgtcaacgtcgaagtgctgccgtacgcagacgttgttgtcagcagcctgagcaaaatcttcagcggcgacgccaatgctatgggtggcagcctggtgctcaacccacaaggccgccactacgcagcgctcaaagctcacatggcgcagacgtacgaagacgtgtactttgacgaggacgcgatctacatggaacgcaactcgcgcgatttccagcagcgcatcgaggtcgtcgacggcaatacgctagccgtctgcaccctcctgcgcgagcgctccatcgtcgggggctccaccgacgcgcacaccgtcgtcaaggacgtgttctacccacggtggcagaccgccgagcattacgagaagtgccgccggccggacgggggctatggcggactattctcgatcacgttcacgaccaccgcagcgtctcgcgcgttcttcgacgcactccgctgccacaagggcccgagcctcgggacgaactttacgctggcgtgcccgtacacgattctggcgcacttcctggagctggactgggcggcgcagtatggcgtcgaggagggccttgtacgtgtcagcgtcggcatggaggagagacaagaactgttgaagatcttcgaggatgcgctgctcgcggcagaggcgacagtggaaagccagtga

SEQ ID NO: 296 - DNA, 951 bp, Ceriporiopsis subvermispora
atgcgggtctggtacatcatgcattacgtctactcattgccacccagcgcggtccacatcagcaacaatctatatacagtggggaaattagaccgtccgtcagtctcgctgggacttgattactttccaacccgaacctttccaacccttcgccgtcggagatggagcggaataaagcctggctgcggggcgctgcgggacataaaggaggacatggagatatctctgatcaagccgaacttggtacttcggaagacacggcacgacatcgcgttggtaagcatggcgttgggtacggtgaacatcgtgcggtatgtgacgggaacgccggtcgcatacaccattgcgacggacaaagctatccgactcacacaaagtcgagttgtcaaccctgcaaaagcgtacgagagaacgcaggaagatactcccccgtccactcgggaattcatcaggagacgtattgagattctcgtgtacctgcgtcatgctggattagcagaaactgaaatgaagcctctcgcggggctgctgcacccatgctatgttcaagaggctcagaggatcattcgatgtgatggcttcggcaagtccccatggattacgcagcacaaacttggatgcgtttcgtctgaggacaaagttgaacgaggaaacccactgagaaccccgctgtttacctctgcgactgatcgactgcgaaagtgtacatccacgacatgtgaaatgcacaagggcccagactcttttaagacgcttcgggtcggctcacggtcccagtgggcaagcgcaatacatcgtcaggccgacgttgtgcgagtatgggtggacagcatcgattctgcactcgctgcgacggagaacctgccagtggaggcgcaggaactgaatgatgttcttgcactcaatgaggacgagagtatcgggtgccaggtggagactcggagaggatga

SEQ ID NO: 297 - DNA, 1371 bp, Ceriporiopsis subvermispora
atgctcccctcgctgagaaactaccttcggtttattgatctcgagaacgaattcgcggatcatgggtttttgccaaagcctggagccggcttcaagcttgtgcaaggaatccgagagagctggactgacttcaccgctctcggacccggttacggtacatggaacgtgatacgctccgagatggacgacatgatgctgcggcatgcatccaagcaaggcgtcaaggtcttcgaagaaacccgtgtcgagaccctcgacttcgcaggggaccgcgcgtcttcgcgcccgctcgctgcgcactggtcgaacaagcacggcgcagcggggcgcatcacgttcgactggctcgtcgatgcctcggggcggagcgggatcatgtgcacaaagtacctcaagaaccgcacgatgcgcgagagtctgcgcaatgtcgcggtgtggggctactggaagggcgtgacgcgctacggcgagggcacgaagcgcgcatgctcgggctggttcgaggccctgacagatgaacaagggtggtcttggaccattccgttgaatgacgggacaacctcgattggcgtggtgatgcatgaatctgcgtcgaaagcgaagaaggcccaggccaaggccgacggccagaaaccgacccttacggagcactatctcgaccagctgcagtacctccccggcgtgcgcgagctcatcggcgacggaggcgaatttatccccgggagcacgaagagcgccgcagactacagctactcggcttccgcgtattctggcgaccattttcgcgtcatcggagacgcagccaactttgtggacccgttcttctcctccggagttcacattgcgatgaccggcgggttatctgcagcgataacaatctgcgcatccatcaggggtgacgccgatgagaatattgcacaaaggtggcacgatgccaaggttggaattgcgcataccagattcctgttcgtcgtactcggcgcgtaccagcaaatgcacttgcagtctgcccctgtcctgagcgatatcaatgcagaaaactttgacgatgcatttgagatgttccgccccatctacggcctcgcagacagccagacaaggctcacagatgcaaaggtgcagcacatgatggatgtctgccaaagcttcttcgacccatatgtcagcgaggagcatgtcctcggtgtacgtgcacgctatggacctgcatctgccacgcttgccggccccgtgctgggttcggagcagatcgagcagatggtcggtggtgacaccccagagcgtgagatggacacgcgcgtgctgcgcaagtttgatgcattgaaagtgttcagtgacgatgtcgaggcgacatatatggagcgaactgtc

SEQ ID NO: 298 - DNA, 1578 bp, Ceriporiopsis subvermispora
atggcgacagtgcatcttcacgatgagttgacgcaatctacggaacgggtcacggtccagacgcgctttggcacgatcagaggcgggcgtgctgcgaatggcgccgcggtcttcttggaggttccgtacgctctccccccggggaggtttttggacccggtcccattgcccgcggactatcagtatgaggagaaggattacatctacgaaagcagctacgcggctcaaccgattaatgacggtcaggcagctagtgtgccattcgaggacaaagtcggacgaggcgaacccactgagaaccctctgttcgtcaacatagtatccccgccgtcgtttccctctgcgactggcttgcctgtgaaagtgtacatccacggcggcttcttgcagtttgggtcgcctcacggtctcagtgggcaagcgcaatacattgcggccgagcgatcggaaatatgggtcaacgtcggataccgcctttccgcgtttggcttcctggcatgcgacgagccacgcgtcgaaggaaactttggtttcaaggaccagtggttggcgctgctatgggtccgtgacaacatcgaggcattcggaggcaatccagacaacatccaaatcagtggtctttccgcgggtgcccattctgtacatcagcttctgcattacgcttcgaggctgccagagggcaaaacggcgcccttcaattctgcagttctgcagtcgaactccattgtaatagccccgaaaacccccgccgagctgcgcccgcaattccgcgcgttctgcaccgcgctctccctcaacccggacggccccgacgccttaaccgtcctgcgcgacccggagctggtcccctggaaggccatcacgcacgcgatcgagaccgacgcgctcgggacccagtttggcaccttccgcggcagcctcgacggctcctggctttcctctgatccggaatcaatggcctggcagcgctccggcgcgttcgcccgcgcgttgcgaaagcgtggtgtgcggagcatcgcggtgggcgacctcacggaggaatggtacctgtactcgatcgcgcaccccgtgcggcgcatgcgtgatattgagctgaacatggagcggtattaccaggaggaggtcgtccacgccatgatggcgctgtacaggcgcgtccccgacggcgcgcctcccgaggattttgcgcgcctgtttggggagatgctgagcgaaggccaggtgcatttgcctgtgcggttgctcgcgagggacctcacgacggctgggttcccggtggtgcggtaccagattcgatggacgcccgagcagctgaggcctctcggatatgtcacgcatggaagcgaccggtcgctctgggcgcttcgtctacccgtgctcaagccagaccaggccgatgttgcgcgtgcgtggctggacagcatcaattccgcactcgctgcggcggagaacggggaggtacgagggctgaaggaggttctggctttgaatgaaaaccaaagtatcggatggagagacgatgacaagtgggacgagatcatgcgcctttgtcaggcgttgccgggggaggatgcataa

SEQ ID NO: 299 - DNA, 1080 bp, Ceriporiopsis subvermispora
atgaaggctgtggtaacaaacggaaacggggcatttgggctgaagtcagtcaaggttccgacacctgggcggggtgaggttctggtgaaggtcatcgccgcatctcaaaatccaaccgactggaaaacggctatgcttcatctcaagcctggaaacatcttgggctgtgactttgcgggtgtcatagcagatatcggcccagatgtcgacgcctccttaatgataacgcgcggcaagcgcgtcgcaggagccgttcatggaggcgtcagcccaaacggcgcctttgccgaatacgtgacagtactggcggacatggtcatcgcgatcccagacaagctttcattcgaggacgcttcgcaactcggcatcgcttgctacacgacatgccagtgtctctaccaggaactacatctaccgacgcctctggaacccctagaagtgccgatggacgttctcatctggtccggcacgtcgagcacaggtcaatatgcagtacagtttgccaagctcgcagggttgcgagtcctcagcacggcatctccgaagaattttgaacttgtaaaagatctaggtgcggacgaagtcttcgactacgcagactcgaagacagcacgaaagatcttcgcggcgacgagtggcactctgaaacacgctgtagattgtatcagcgagggcatgaccccgaaccaggtcagtatgtcgctgagcaaggaagggggaacgattgccacgcttttgccgtacgaaagccgtaagaagggtgtagagacacgatttgttcttgcgtacaaattctttggcaaggacatcgagttccctttcgtcttcccggcggatcaagagcataggaagaatgctcctgtgtattgtagactcatacaggaagtcatcacctgctttgggctgaaggctacgccggtgcgcatcttcccttacggcttggcgagcgtctcagatggatttgagtatatgagatccgggaagctttctgcggagaagatcacatacagaatttcggataccccaggtctagataagtgggatgtggccccgactgggagtgtcagaggttcctcgtga

SEQ ID NO: 300 - DNA, 975 bp, Ceriporiopsis subvermispora
atcgtttcaatggtgatcacctcgtccatcgtcttccttgtacccaacatcaagagaaccaaggcaggcgagtccagcgccgcaaagctcctccgtttcaagcgattggatctccttggtgtcactgtattcacggcatcactaattctcttcatcttcgctgtaacgtcgggttccatcgatggatggggatcggccaacgtcattgcacccctaattatttcagtggtcctcatggtcctcttcttcatttgggaggcacgtctcccggagtcttacgctgcgcttccaccaaagatgtggcaatatgaaaactttacaatcctcactgtcatctcgcttattcctttcatgtggtggggctcaatcttcccgctcttcgcttggctggacgagctggtctacggctggtcagcgatcaataccgcggcacacttcctgcccatcgggcttggtatttttcccatcctgcctttagctatggggctccagtctaaactacgtctaaaatgggtcatcctcatcgggtttgtcctgcaattagcgggaaccctcctgcttccattcggaaatagcaaggagcgctattggcgtttcgtcttccccggctttctactgggtacagccggctcggggctcatttacgccacaacgaacatcgcactcctggccgtgactccgagctcagtctcgggcattgtctccgcggtgttcagttgcgtcctgcaaacggggggcgcgacgggcgttgcgatcgtgacctcaattcagacgagtgtgcaaggctcgcacggtggaccaaatggtttcgcaggacgtgccgcggggctctggttcctcgttgctatgatcgcgacaatgatggtgctctttcttgtgttcatgaaggacacagtgggccccgtagacccgacggcaccgccgccgcacctcgaatatgagatgaatgagagtgcgagagaacagtctgcctga

SEQ ID NO: 301 - DNA, 252 bp, Ceriporiopsis subvermispora
cagcttaatatacccaatagtcagagcgtttggctgctgagtgcataccagctcacttttgctgctcttctcctcgtcagcggcagagtgagtgatctgtacaacccaaaatgggtatttgttacgggatccactggcatggccgtatttgctcttgtcgccggcttcatgcggagcgagattcccctcatccttttccgagcacttatgggtgcaggtaagacatcgcatcatgcgtggagctcggcctaa

SEQ ID NO: 302 - DNA, 1563 bp, Ceriporiopsis subvermispora
atgttcaacttactggactccgccaaaggctcgcacgcaacgacgttcctcgtcgcctcacttgttttcctcgtcttgaagcagttcttcacctcgcgaaagatggccaagcgagcaccgggtccgacgcgctggccattcctcggcaatgctctccaacttcctcaacaacagatgtggctgaccttctcggaatggcaaaagacatacggcgacattattcacgtcgacgtcttcaaccagccgatcatcattataaactcctcgaagatagcgaaggatctcttggacaagcggtcctccatctattccgaccgcccgcatctggtcatggccggtgatttagtgggctacagcgacccgtttgtcctgcaaccttacggagaaaagtggaaaaagcagcgcaaatttgtcgcatcagacttcagtcccgccaccatgccacggtattaccagctccaagagaccgaggttcgcaaactggtccgcaatgtcatcttggacccagattccctcttctcgcagactaaattgcggattgggacaattatcatccgggttacctacgggtactacatcaagggcgagcaggacccgttcctgactttgcctttgactgcgatggaaaacttcagcaaggcatcggctccagggacatggctcgttgacttcgtgccgcagatgaagaacatgccctcctggatgcccggcgcgggctttctcaagacggccaagaaatggcgcaagatcgtctgggatgcgtcctgggacccatacaactggtgcaagaatggccttgaaaccggagagacgctcatgccaaacctctgcgggagcgctatccagtccgccgcagatggaaagctctccaaggaggacgaggagcagctcgtatgggccgcgtccgcaatcatgggcggcggcctcgacacgaacatgtccgcggcgttgagcttcttcctcgcgatggtgctgcatcccgccgtgcagaggaaagcgcaggccgagatcgacgcggtgatcggctgcgaacggctcccgtccatcgcggaccgcgacgcgttgccatacgtgcgcagcatcatcacggaggtcctgcgctggaagccgcccgtcccgctcagtatcccgcactcgctcacgcaggacgacgtgtacgagggcatcttcctgcccaagggcgccctcatcatgcccaacgtttggcacatgatgcacgaccccacgtcctacccagatccctccgccttccgccccgagcgctacgcgggtgcggacggtgacgcagcgcagcgccgcgtgcacgagcttgtgttcggcttcggccggcgtgcgtgccccggcgtgcacttcgccgagggcacgctcttcgcgcttgtcgcgaccgtcctcgcgactgtcgacgtccttcctgcgctcgacgcgcagggcagggaaatcaggcccgacccgaagtactcgtctggtacgatcacgttcccggaggcgttcccggtgcggttcagtgtgcgttcggagcaggcggaaacgctcctagcgcaggttccggcgggtcctatgtga

SEQ ID NO: 303 - DNA, 1029 bp, Ceriporiopsis subvermispora
atggcgattcctaatgccacgcaggttatcgaagaacttccgaacctattcacgccgatggcgttcctccctccggacattgcctaccagacgactatcggcagctacatcctaattggctcactcggcgcatttgtgtgggacctattgaccaacctgcaaaacgactacaagttactattcaagtgcaggattggacttcctaccgcagtatatttcttgtcaagggtttcatccttgttctatgttctggccagtacaatctttgaaactgcgcccataggacgttgcgcactacttgagaagatcgtggatattatgtacccaatctccgtgtcttcgacctgcctgctcttcttctttcgcatccgtgctgtcttcgacagaagcaacataatcgtcgcattgttcttcgtcgtttggctaagcgtggttggtggcacacttaccatcgtcactgctgtcaagtcaatcaacattggaccgacaaactattgcctcaacgcgagcctaaagtcgtatgcgtcagctgcggggattaccccactcatacacgacacgcttgtattcgtcgccatttccttacgtctcctcatgaattccagggtggactggagacgtgactggaaacttcaggccagggcatttgttacaggtgaatatcttccggtgttctctcgtgcactcctccaggacggacagttatactttatgttcacggtcggcagcaacttactcaccgtggcaatggtgtacgctaccggtgtccctgtcacgtatcgcacgatgtttactgtacccaacatcatgctcacaaattcgatgtcgtgccgcgtcttccggaacaccaaattcggcttgttcagggatatctcaatgtccactatggcgacccacagttccatacgagcaggctctattcctctttcgctcagaaataatagctcgcgcggcgaaaacgacacgaatacggacatcagtggtactacggtcaaaatctcgaaggtcgtcgagtacgccacagtatga

SEQ ID NO: 304 - DNA, 7725 bp, Ceriporiopsis subvermispora
atggcatcaggtgttgctattgttggcatctccgtagagctgcccagtgggaactattccgaggagaatttagaccataattctttcttcgaattcctcctgaattacggcgaatcctacgaacggcttcctcgagaccggttcaatgtcgaagcttggagaggtaacggtatcgggcaaatccacgtagacgggggcacgttcctcaaggaaatcgactcgtttgacaacatcgagttcggagtttcgtcgcgagatgcacgcgcaatggcgccggtcaccaagaaactgttggagaattgcttcctcgcgcttctcgactcaggaatcgactatcgtgcacggaacgtgggctgctacaccgccggaaattcgttcgagctgtcaaatatcactgaaccagatgagtacgaaccgcaaggatcgttcgcgggatacgcggcaatggtggcaaaccgcgtctcgaaccatctcgacttgcttggaccgtccctacctacggacactgcatgtagctccacgctcgtagcgctgcatctagctgtacaggctgtgctgaatggcgattgtgaggctgccgttgtaggtggctgccagctcaaccatcgcctcatggattggatcacctatagtcaaggctccctgctcgcgaaggatggcaagtgcaagcccttcgacgcgtccgcggatgggttcgcaagagccgaaggttgtgtcgctgtcgtgctcaaaacactcgaagatgctctgcgggacaatgattatatttatgctacaattcttgggacagcgatcaataatggcggcgctggagcaccacctggggcaccagttgcggacgcccaacgtgatgctatgttgcaagcgtttcgtcgcgccggaagatgtcctaaggacgtcgattatatcgagctacatgcaaccgggaccgcgaaaggtgatcccacagaggccaattgggttggcaaagagttccagagggaagacgaggtgttgatcggcagtgtcaaggggaatatagggcacacggagataacagccttcctggcgtccttatccaaggtgctctcaattttgcaacgtggcaccatccctccaaacgtgaacctcaccgaccctaatcccgagatcaagtgggcagagtacaggctgaaggtaccgacgagcccaatgctgcttccccgccattcgcccaacacgcacctcgtctcgatggctggctcgggcatcggaggctcgaacggccacgtcgtcctagagggcccgcctctgcgagcacccgtgggtgcgcagcaacacctaaaggcgcgccgtccggtgctgctccttgctggcgggctcaccccgcgaagtgcagctgcagtagcggagtcgatcattgcgtgcatcgaaggcggcgaggtcgacgtgtctgcgatgtcgacgatcctcgggcgccgtgccagacagatgacgtggaggtcgtacgtagtctccggcggggacacatccaattcgatcagctttggcgagccccagcattgcccacgcaatgcaaatccgctcgtgttcgtcttctcgggtcaaggtccccagcacatcaacatggggcgcgaactcttcaagacatttcctgtgttccggaacagcgtgctgaacatggacaacacctacaagaccgccactggaaagtctatcatcgacgactggggcttgttcggcgggaactgctcaacagcactgccagatgtgtggccgatctccctcaccctgccagccatagcaatcttccagatcgcattattcgacctccttgtccatctcggcatcaaccccgacattgtcattgggcactcagccggcgagaccgccgtgctctacgcgtcgggcgctgcgccgaaggcaatgacggtcgaattggccgttctgcggggcgttatcttcacccaattggaacaccagggaggtaccatggccgcgctatcctgcactgcgcacgaagcgatgcagatactggaccaggcctgtgcgcaggagccggggtgcgcggttgagattgcctgctataatgcgccggcggcggtcgccatcgccgggcacatgcgcgcggttgatcgcgttgtagagcttgcgcaggcccgtgggatatacatacgcaagcttcctactcgggtgccgatccattcgtcactgatggatgcgtgcagggaagagtattgcggtggcttgtatgagctgttcgcacgttaccctggggcgcatgtcccaaagattctgacctactcgacgcttacgggagggccgtttggggggccattcgatgccgactacttttggcagaacacgcgcggtgaagtgcgcttcaccgaaacagtggaagcgattgcttcgtacggaagtcatactttcgtagagatctctccacgacctgctttggcatcctacgtccggtccatggcgcaagagccgaacattgtcctcaccaccgtgcgccggcagaggtcgggacaggacccatcggaatatcgcgacgtcctcgaactctgcgggcaactcactattactgggcataattgcgttgactttacggtactcaacggtcgagcgtgctatgaagtacaggtccctttaccttcttatccattctcgaagaagcgattcccgttgtatcctgacactgccggctacagaaaacagcttgagcctcgtcgaggacctttgaaccatagacatctccgcgtcaacaaggagtcacatccctcactgggtgaacatgtcattagaggcgagccgataatgcccgctgccgggttcattgagatggccctagaatttggagcacgcacactcatcaatgtcaacctgcaatctatcctgtcgctttctgcggaaaggccagtatcgttacaagttcgactccaaggctcattttggactgtatcatccacggttccaacgtccaagatctcctcaaatatagactcagatcatatcgaacgactacatgccgatggattcctttcctttgaagcagtaccaacatatcccgatctcgatgtatctggactccggaaacatcttcagaacaatgtcggctcagatttctatccctcactttcctactattcttcatatggtccgaggatgcgacgcgtgacgaacgtatactttggccgaaacgaggcactggcatcaatctgcggaatggatgacatactctccgaggatgccgcctatttcttacaccctgcaattctggatgcttgcatacaagtctccgcatacaagcctttccacggcaatttcgaccccaacgtttactatctaccagctcatgttgacgcagtcttcgtccatgagccacttaagaccagctattttcctgcccatctatacgctcatgttgaattgagggcgtggcatcccgaccatatgcgatacgacgtctccctcgtgaacgattttgggaagaggctatgtacggtcaaaggcttgagaatgacaaaacaccacatcaatccgttggcaagtgtctccggccctctggagcttgttcttcagcctatttccatcctatcacttccgacgacatctggaaggatctccactgcacatcaaaacacccagctcttcgagatatctgacgaaatagagctgcaccatcaataccgaaccaatggggtacacgactgctccgatgtccagtattggtgccatagccgtgacattcaagctcttaatctagagagtcaaagtggactctcctcacacgaggacacgaccggctccgtaattgaaggggtgttgcacaccattttgagccacatatccgatcaatcacatatacgtgtgatccgggtcttgatctctcgcttgcatcccataatgctcgaatctttcgctcaggtcttgaaggggttcccggctgtcttcttcgagatatacatcagctcggacgacacaagtgcgacgcttctagtagaagacttctcagggattgttcgcactgctgcgactgacatccagcgctcatttttcgaaatgatcttcacatcgccaaatgacttcccagaggcagtgatacagtcatttggtagcatgttagtacctggaggcgtgattgtatttgccgaaggccttcctaagcctctgggccacagatacctcagcctcgacaccgtccgacacgtgtcatcaacacccacactcccactcgaaacgctggagaagttgggtttttctgtggtacagccccatggccccgactgtgctattgcgcagaattgtaccgccgatgctctccaagccaccgaacccttatatgatccactggaagcattcgtattccaatacgaactcagaaacgaggtcgaattgcagtgggaatttagcgggctcaacattaggcaagagctggatgtctggatcctcgcttcggaaggaaaagatggtggatctgcggtgggaatggtacgggccctgagaagggagtattcatcgtggacaatccgccttgtcgtcttcccactctcgtacccggaagagatgcggctccaatgtcttcgccgacttcccacctacatgaaagaggaactagacattctcgtatcccgtacaggagacttcacagtctttcgattggcccctgtcggcaggccgccccatgatcacaatcctgcccgctggaacgacacgaccagtgatatcccccacggacatgttctcgtacatgttctgtattcgtccagccactacgatatttcagcattggtggcgtccgtagacaatgccaacaataccggtatccgagagggatccatactattggccatgattacaggtacccccggaacgtcgctcgtcttggatgttactatcacttgctcagtaccgccatctctccttgagcaagtatcgatggttgtgcaaatgatggccccgctcgtgacggctgtccttgctcccggtctagccgccttcaggtcgccagctcgtcttcgaacattacgaatcttattgactcatgctgatatcccatttgggcgaatcataaagagtatctatgcggaaaaggcgacactcactgaagtagtcgagaatatcactctctttgatctagcgtcactcgagagtcagccatttgacttgatcatatccggatacgacgatcacgcccacagtcaagtcctccgttccatactcagacccggccgcggaagactgtttttgtggggcaatcgtcaaggtctccgcgaactcatagatagagagctatacacagttgtggatgccatgaactgcgttcttcagtctcttgacgagcaaccccgcatcatatgcgaaaacacatcaattaccccttcattggcgccatccgatgtcatcgtgacacaagtcagcccacaggccatatccactggagtcaccttcagtgccgacaaaacatatctgcttgtaggaggcattgggagcattggagcgcgactggcactctacttgtacgagagaggggctcgacatattgttgtctcatcgcgtaccggggcaaggggccttcgcacaagtaacaatcttatggtgtatcgaatattcgaatatctcaaggggatcagcgacctggacatccgcctcgttgccgtagacgcatcttcacgacacgaaatgaagacgttgcgtgacaacatcaatccgaaaatcgccggatgtatcatcctcactgctgtactctccgaccgtgtgttccaatacctcgaggaagagcagtttactgccgttttcgctgctaagattggagttctcgatgctcttattgacacgatagacgtatcgagtctcgagtttctcgttgccttttcttccgtctcaggcttgttcggtgtcggtggtcagtcgaattacggcgcagcgaattcaactctagaggagacgatgtcagtaatctctaacgggttctgcttcgtgtgccctgggattctcgactcgtccttgatgctggctaatgggatggataccgagaagcatcgccttgctcacttcatagagtggtctatcacaacagatgaaatggttctgtggttcgatgacgcgatgacgagataccagggtggccaaaagttcagtcgttacatccccaatctgaattgggaggtgatggaccgcacgcacggaatgaacaaactgggagcacatctagttccgacgcgcacggctaaggcacctactacggaggacgacacaggtcgagtggcagagattgtcagaagcaccttgaatatatcctcagacgacttctccgcagaagtacctttcaccgcatacggtctagactcgctctccgcttcaagattgtccttcatgctgcgtcctatgatgagcgttacccagatacaactcctagcggatatgaccctcagagatctccagactagactgtccgccgaaccagtgtcggaggattttcgggccctagagccgaccacgggcaagaatgaaatacaagcgatgcgcgacatgctcagcaaatatacgcaggatttacgggaacaaagagctacaaccgacatccgagcgacgcgcaacgatgttgtcctcctcacaggaagcactggcgctctcggtgccaacattcttgctcagctcctcgacaacagcgatgtcacgaaggttttcgccctgaataggaaaggcactgatcgccattgcctgattgagcgacaagtggctgccctcgtgacacagggcctgccgcctacgttggccgaatcgcagaaactggtgctgatcgaaggagatttactgctggatggacttggtattccactagaggtgtttagtgagatgctatcctcagtgacacacgtaatccacaatgcctggaccatcgacttcttgtcctctctggaggcaatggaagatcttgtaaggggcacccgtcggctattggacattgctgctctctcgactcgtgcgactcctccatcattttcctttatcagttctattggcatttaccagcattattcgggttcggctccagcaccagaggagcccgtgctcgatgcgaagatggccgtacagaccggttacatggagtccaaatgggtggccgaacgaattgttcagatagctggcgctagactcgggctcaaagcgcacgtgattcgagtcggactcctgacaggaggcgtcaatggctcatgggatcctacacactggctcccagcgctcgtgcagtctgcaacgtacgtagggtgcctcccagaaagcgatagcctcgtctcatggatcccggtggacgtcgctgctgctgcggtagttgatctacgccacgcctctgatgatacactccatgtgattcaccctcgcccgatgctttggtcagacatcatggttcccatagcatcgctgctcgatgttccacttgttccctacatcgaatggttctgtcgactcgagaacatggccaacgcaatctcccatgcacctagtcagcgagacagccggcggctgaggcacgcgctcagacttattgatttttatcggctgggaatgcgaggcagtaagggagtttctgggtccacggagagcatgggtctattgccgcaagtgaaatgtcagaaggcaatgcgaagttctgcgacactgcagaatcccgaactatgtcaattggggatcagcgacatcgaacgatgggtgtcttattggcgacaagccggtcatctgccaaataatgactcgccaaactga

SEQ ID NO: 305 - DNA, 846 bp, Ceriporiopsis subvermispora
atgggcacggttggcacattcgatgcgattatcgatgtcgttttgaacattcgcgtgtggacatctatggacttgagcctgttcaacaagggaggctggatccgcctcatgaagaatgtcgacacagtggtaccgtcaatacttggggactgtatgctgatttatcgctgctggattgtgtatgatcgcaggtggaaggtcattgcaccctcatttatcctgagtgttgctggtattgtactcggcatcacatttgtcgtcctctccggagtcttgcagtcgccacttggagtcaacaacccagctttagtgccattcgttggtgctgcgttggcgctgactgtgacagtgaatctcatcacaacgtgttcgtcttcaaatagtctctgcgcgctaccagagctcacaacagagtctggtactacagcactcatcgtgtttcgcatcctacaagtcgaccgaggagtccgaatatttgtcactcgaaacgacaaactcgttcacttcgctcgcatcatcatcgaatcgggactcttgtatacgctatcggcagttatcactctttgcacgggagccaccactagcaacgccgactacatcacgagtgatgcgatggtccaaattgctgggattgcattcaacttgattataatccgcttcgagaagaacctagcggatcaggccgcggttgaactgcagtttctcgcatcatctagagctgcgcacaccattcctccgttagcaggcggggacagagtgattgatatcactcataccccaaagaataatggcctctttgatgataattttggtgaggaagggaatacacgagtctgtactctgtga

SEQ ID NO: 306 - DNA, 786 bp, Ceriporiopsis subvermispora
atgcgttcctccactgttaccgctctcgccctcgctgctatcgtcgcgcccgttctctctgctcccgccctccctgttcgcgacagcattacggtttcggcgcaggatgtcgagcagtggacagaggagacactcgacgccgcgaacatcccggtgccttccaccgctgtccacgaggcccgcaagttgtctcctcctcgcaagacccttgctcctcctaagccgaagccgtccaccgcaacacgcaatgccagcggattctctcttcatcacaagtccccccttgctcctccgaagcctaagccgaggcccacggccacgtcgcctgctcctaagtttcacccgacaacggtgcccctggctcgcgacagcgacagccacagtgacgctcccgctccttcggacggtagtgaggccattccgatgcagcagctcgagcagaaggcctcctccgcaacacacattgctcgcggattttctcttggtcacaagactccccttgcaccgcctaagccgaagcccacggtcacgtcacctgctcctaagtttcgcccgtcggccgtggccctgcctcgcgacagcggcagtgacgctcccgctccttcggacggcagcgaggccatctcgacgcagcaactcgagcagtggggtgaggacgccctggacattgcgggcgcagtcgcgcccatcgctgagttgttcctccgggaccttcgcagggacgagcagctggcggcgctcgtgatggcgcaccagaaggctcagagcctgaacgaccttgattaa

SEQ ID NO: 307 - DNA, 1824 bp, Ceriporiopsis subvermispora
atgagcaatgttgaggcaacatcgactgacacgactggcacggttcacgaactgaagcaacctgactgggcggccgcacgagagctgagtctccgcccaggaggattcggtgctaaacgagtagaactatggcctcaattgctgaacgtggaacacccggcaccaaagacgtccgagctgcgagtttctgaaccgtctgcatctgcaccagacgaagcatctcatgaatcagacgaggttgataacgaaagcatcagagacacctccacgatagctccgcacaaggatgaacgtcagatacagctggacactgaccggagcttcgtgctgtatcccgtagacgacacggaggaaaaagatcatctacagtcgcagctgaacgaactcatcgtctgcctcttccgcaagagacaacatctcagttacttccaggggtaccacgatgtcatctctgtggtctacctcacgctcccacgagagttgcaattacccgttgcagaaaagatcagcttgcataggctacgcgactctatgggcgcgagccttgaaccggtagtcggtttgctccgtattctgaaacggataatgcatcttgcagatgccgaatttgcgacaattctcgaacggaacgctccccttccatattatgccctgtctagtctgctcacattactatctcacgacgtccctactcttcctctcatacaacatgtcttcgattatctgctgagtaggcctccaattgcgctggtgtacctcgccgcagccgtcattttgacacgccgagaggaggcgataatgctcgagcgggaaggcgaggaaggcatgattcactccctcctcaccagtcttccggacttgtacgaggaaacggacgaagagtcgaaggatgaagacactggggctcccccaaaaggtgatggatcgatatctcaggacgaatcgtcagcccagcaatcggcaccagagggagctaacaacgttcctacatcggacggcaatgtcccgcaggaccctgtcgagcggcctcatgacgacactatgccgtcgagtattccaaacatcaaggtggaggatgagggagctgcagatgcatctcttgaatctcagactattggagaaagcgacgtcaagaccgaagctccatcagaagcattgttccagtcggcaccagccatcgagacgggcgacacccccccattctccgagaaacacgaagaaacagcacctccttcgccaacgctttctatccatctcacctcgcgacctcgcatacctctcagcagcctcctgcgccaagcagacgacctctacacccgtttccctcctactcaccctgaagtggctgtctcctccatcatggggccgcagagcgtcatgcttacatggtccgaggacccatccgagctcccagacgacgaagaggccgagcgcatggtgctccgacccgagctcatcgtcctgccccacatcgatcaggacgaagaagtgccatcagacgaggaggacgagaagtccactcggtccagaaggagaggagggaaggaccgcgagcgtaggcacagacgcaagttgcggaagccccgccgcatgggcgatgttgtcctgcagcgcaagaccatggtcgcgggtgcggtgctcgtcctcggcgtcgcgatggccgtgtatgggatacagtccggcggagcggcgaacatctttggtgtcgcgggcgaaggccaccgccgccaccagcttgaaaaggagtggagacggttgagcggatttatcgggggagcagtcatcggagtgggtgaacggatgtttggaggccttttgcattga

SEQ ID NO: 308 - DNA, 8259 bp, Moniliophthora roreri
atggtttcaactccatcctctgccattcgccccagctatgccaccactgactctcatgccatggccatcgtcggtacctccatcgctgccccaggcggcgtcgacgatggactagacactgaggagttctatgagttcctcaaatctcgtggctccggtatcatcactgtacccaaagatcgctggaatgctgaagcttatcatggcgctcaacctggcaaaattgttactaccaaaggtggttacatcccaaacgctacatacggagacacgcaagaattcggtatcactcctgcagaagctgcccagatggctgtttctcaaatagctttgcttcaccacgccttcaacgctttgcaacgcagtggagtcgactaccgaggcacgaacactggcgtgtatgtcggttgcacgactggtgcagcaccccacaacgtagacatcaccgaagccggagcatactacatgaccggtagctcgatatctatcaatgcgaatcgtatcagctacgttttcgacctgactggtccttccttgccagtcgatacggcctgctcttctagtttgaccgctatgcatctcgctgtgcaagctgttaggaatggagaatgtgaccaagctgttgttgctggagtcaacatccttctcagtccacttgagactgcatccttcagtcagctcggagtcctcggcccagatggtatctcgaaagctttcgatgaagatgcaaacggttacgcgcgtggtgatgttgtcagtgccgtggttatcaagcgtcacgatcttgctgtcagggactatgaccgtattctggccactctcgtcggcactgctcttacgtcctgcggatccttgatgggatctctcactacacctagccccgatgctcaaaccaaggctattaggaatgcctacgccgatgctggtctaacacccaaccaagccgacttcgttgagttacacggtactggaactatcgtcggagatcagtacgaggccaatacggcaggcgcatgcttctctgacggacgtgacggtcgagaaatcgttatcggctcagtcaagagcaacgtcggtcacggtgaaatgggtgcttatatgagctctttggtcaaagttgtcatgatgttggaacgcaagcagattcttccgaacggatacttcaagaagccttcttcgaggatccaatttgacgagtataagctgcgggtacctatcgaagtcgaggactttgttccctatgacgtcgagcagggtctcatcgcgtcgatttcttccttcggattcggaggatcttgtggtcacactgtcctgcgagaacacgatgttaggcccgtcctccctgactacgaaacgctaaactcgggaccatatctcttcgccgttggaggtcttactcctcgttcagtcaacactctcatcgagagctacaaagccgagtacgcggatgtcgaccctctatccctatctgaacacctcggctcgcgtgctcgccaattgagctggcgttcattcgcagttgcagattccttgggccaggcaaagttcactgaacctgtcatggtctcaaaacgtgctgttcctttgatcttttgcttctctggtcaaggccctcagcactggcaacagggtcgcgaactcttctcccgatactctgtcttccgtgaaagtatcttggcttccgacaaaatttacaccgagtacacaggaaagtccttccttgaaacctccggcctctttgtccccaaccctcctgcgaactctatcctcgccaagtccctttcatggcccgcagacgccatctctgtttccatcactttcttccagatcgctcttttcgacctttcgatctaccttggtctcaagcccgacgccatcgttggacacagtatcggcgaaactgctgttctttatgccagtggtgctatgcctcgcgagatggtcgtcaagatcgccgttgctcgaggtgctgctcttcgcctcgttgacaacattggtggagccatggtcgctgtctctggttgcgacctccgaacagtccaagattatgccgaagcagtcgttgacctttccaacaacccgacggcgggtgttaccgactctctccacgtggcagctcggaatagcccgaccgactttggtctctcgggtgctgagtatctcgtcgacgaactggccaagtatatcgaccaatgggtctctggggtctctgctcgcaagcttcgtgtcagcactgctgttcactctccttatgtcgatgcttgcgaggcccaataccgtcaagagctcgctgcaatctttgaagcacaccctggtacccacaagccttcgcttccagtgatgtcaacagtgacagccgagttcgttgagaaggagtacacaatcgactacctctggaacaaccttcgtcaacctgttcgcttctctgatgctattcccaagctcatcgagaagcacggtgaaaacacgaccttcgttgagattgctcctcatcccgtcttgtctcaatacatcaagcaaatgggtgccttcgagtcggtcgcgggtagcaaacgtcctccttcggctcgtcacatcaaggctggtcaacgccctcctaccgagctcgatgcactgtacgaagggattggccagctgttggcttcaggtgtcaactcggtcaactttgcactccttaacggttgtcctccagagaacttccttggacctaagtacccattccaaatgaagtacttcccggtcgcacctcgtgttcccagctatgtgcgcaagctgctccctgccgagagaccgctcaacagcgaacggctccgtatcagcccccatctgcctgaagattggatggctgatcatgttatcgatcactcgaacctcattcctgctgctgcgtatcttgaaatggctctcgagttccctgacgtcacttcagtctgggactgccgtttcgagtctgctttcattctcgatggttcggtgcctgccgcaaccttgaaagtatctcgggacggaaacaggtggagtgtcaaatcttcaagcgctctccaaagcatgcaaggcgacctaacatggacccgttctgagccgtccttcgactctatccatgcctacggcaagcttggatacggcaagccggagttaagacctggagctatcacccatgttgatgttgatgctgtgattgctcgctcgaaagtacaagcttcgcatgaagcactttacgatgaattgagtcaagttgcccaatttggaacagagttccgacggctccagaaggcctacgccaatgatgtggacggtattgtttacattaaaggtcacggtgacagcttgactcgtactgggtacacattccatcctgctctcatggatgcagtattccagtccggtgtctgttttaacatggtgttcgatcatgtcaacgtcggaaaccctgagcgtacattcatgctgccacactccttgcgtcgcggatttaggaatgatggaagcacagaaccgcttatcttcaacggtgacttccgtatctacgctatcctggctgattggtcgccgtactcggcgacatatgactactatgtgctgaacgacgataatgatgtcgtcttcacttttgaaggcctgcgtttcgaaacggtgcagcaagaccaacaagcaatcaaagaacgtttcagcatgatttggcaaccccgtggcttgcccaagtcgaataacagtggtcatgttacacttgaggatgattcggttttggaacaccaagagttgcttgatgttctagacaagctcgccttgggttacaccaagaaggctctagggcgcctttctcagaacttcgaaacggctctgcctgaccgtaaacgttacatggaatgggcactcgagcgaactgcagaacgggctactgaaaccttcttggagttgagcgatgtatctccggtgatgaggcagaagtatgcttctttgttcgaactcacgcagcgagtcggagaagggcagacagacattttcgtagattcaaaggctgccgtagacatcctcttccgagatgacctcatgagccgaatttacgagcatccacctttcatcggcagtatattcgacgaaactgtcaagcaattcgtcaagctcgtcaaggatgccatagaagccggcaaacgcgttgttcgtgtgctcgaggtcggtgctggaaccggtaggttcacggctttgctcggtcaagctcttctagatgcccagttggaactgtgctacgtcgactacgtttgcacggacatttccatttctcttgctcaggaggccacagccaagtgtccctggatgacaattgtccctgttgcattcgacctcaacaagccacttgatcaacaaagtatcgatcccgcgagctttgatattattgtcgcattcgatgtgctccacgcgacaccaaacattaacgataccgttcgtactctccgtgagctcttacttcctggagggcatcttgcaatcatcgaactggatggaaactcattcgccactggtgctgtcggaagcatctggatggattacgtctttggctctttctcagagtggtttggtgttttggaacagcgtccggcctctcactgctctctgagcaaatcagagtggaacagcgtcctgcattccgaaggattcgctgaggggctcttcctcacatcaaccggggctactgtttctcatatggcattcgtgtcccagaccactgagacggctcacgaacaacaaagctctccaactccttctactccctcgctgcaaagcgaccacagtcctcatcttaggtcattctctttctcctcaacgcccctccccgttacacccaatactcctggcttcagtggagatccaacccgcagtgtcttgtcaatcgacaacgagcatcaactgtcgaagaagttggagggtggggccacttccgctgacaagcaatcgcagatcattgctccaggcccaatcacacttgaagaccaacgctcgtcgtctcaatctccagagctgtcactacctcccaatacaatcattcgtcgattcacggctggggatgaggtcgagttagtcagcttcgtcgctagtctcgactcctcccttccgttgaagatttggctctacactgacacacagagcgacaacgctacgctgatcggactgaccagaacgctcaggcatgaattcggtttctggaaggtgtatcttatcctcttccatccttcttggagctttgccaaccaagaagagttcattcgtaaccagcttatccctcttaagtggttggacgcggaaatcatggttgatgaggatggcaccatgcgagtgccacgtattgtgacaggcgctgccccgtcaaccacggagatggctgattccaagccactgcaattcgatgactcccagttttggcgagcgctccctgccccactgaatgcggatgatgtccaagtcgctgtgtcctttatcacactttccagtgtaattccaggtcattccgagttctctggaaaagtcaccagtgtagggtcagaggtggaaacctctttgattgggaagcgcgtgatgggtgtcaccaagtcacctaaaggcaactttgtggtttgtcctaaaggttgcataacgacgatcccggatagcatgagccttcccctcgctgctgctcttgccggccgcctcgcattcacatcttcagttgtggccgataccttggcgaatgccaaaggtggcgttcgtgtaattctccacgccgctgactgttctccagctgccgtcgcaacatacatctatctccaggagcgcaatttcgatattttcgtgacagcagcgaatccgtctacacatcagattcctcataaggaagttttcgactcaggcaatgttgagatttggtcgcatgctgcacgacaatgggctgctgaaggtgccgacttcatcttcaacttcgaagatggaactgtagtccttgaggaatcgattgagaggctagctcgtcgtggcaccctttgccaagtcggaactctctatcctcaccgcctccgtccaggtcagcgattcgtatctgttgaatttgactgtctattctctggcgaacataacgttctggaagaagccattcagtcaacttccagtcagactatttctcgtatttccccctcaactctcatcttccaggcggatgctctccaattggcacactcaaaagccagcctatacaaggatctctcgattatgttggacttcgagacgttaccgaacaacatgactgtctccaagcctggtagactgcgtggtacgaatacatttgaccctcgtgcatcctatgtcgttatcggaggcatcggtggtcttggaattgagattgcaagattgctgatcgagaagggcgcccggcacgttattctgacatcacgatcgggtagcaaggcattcgacgatggtcggcttgttcgggagaggagggtcctcaacttcttgcgcgagaagcccggggttactatcgacctggttgccgtggactgccttgatgcggcaaagacgaaaactcttttctccaacttaccgaatgtcgctggtgtcttctacgtcgccgtgagattaaacgactcgctattcctcaatctcactacccaggaagactggtcaaaagtgtacgatgtcaaggtcaagggtcttcgcattctcttggatgctgttgatcccagaaaactcgatttccttgtcctgacgagctctatggcaaccgtcagcggttctcccggtcaagccaactatgctgcagcccagaccgaaatggaggcgatgggtgcaaacattcccaattgcatttcagtcaccgttcctcctctaaccgacggtggtgtctttgtacgaagtatgcctactggcaatgctcgtaacgcggctctcgacaaatataaggatctcggcatgactggaatgaagttggcccgtcattgcgtcgatgctatctggactattggaacgccagcctaccaaccagtctacattcccgcgaccaactggaagaaggtcatggaggtcgctgctcctgaataccttcaatctagtatgagacacttgttggtcaaagagaccactgacagtgtagcagccgacggcggcaaagaacaaaccattcttggagcctgtgcggctgtgctatcgcttgacattgaccgcgtcgaagataatattcctctcgctagctacggcttggattcattgacgtcggttcgcctcagtggtgttctcaaggctcgtttcggggttgaagtcacacagctgcagttgttgagtcagactatgacagttgcgcgcttatgtcagctccaggaggaacaacaagcatctgtcaccacaaccgccaccgccaacgatgaccgcacccaagtcgatccggccaaggtgcatgaagcggatatggatcaaactattgtgcggctcaacactccaaccgaaggcactcctctcttcctcattcacggtgctggtggaggtatcgtcgtacttgtcaaagcagcccagagggttcactatcctgtctatggtgtgcaggatactccagaggcacccatcaccggtaatctccgccgattgtcagaattctacttgatgaagatccgggagaaacagccacacggtccttacagacttggaggattctcattcggaacgtgcttggctttggacatttcccttttactgcaacaacagggcgaggttgtcgaatcattggtgctcttggatggttcgcctactctcttcaagcgacctgcattccagtcatatctcatgggacgcatccaagacggcagtttccaggaagacatcctcgatgtcgtcaacgacatggcgtctagtggaacgctcgatgacgcggaggatttaggccgtcagtttgctgaccacttccagcgtgccaaggaaggtggaagtggaccaaaatgggtcgctcgcttctgcactgcctatgtcgctcacctcattatgggtcttcgttgtggtaaagagttcaacgctttagaggcgaaatacggaaaggatgcgatgggtgcttggccagcaaagaggaccgtgctcgtgcgtgctctcagcggtgtatctgctgaaccttatgcagccggtgcttcggagtactttgacttggacgtctatggctcaggcgtggagaagcatgacctgcctggcacgcacttcggcatccttgcacccaaatccggactcgacgccattctcgacaaactgcactaa

SEQ ID NO: 309 - DNA, 1881 bp, Moniliophthora roreri
atgtctgttgcaatgccggatatacccgctgaggcctattatatttacggtcacaagagatatctcgttgcgcttggactcgcgctgaccctctttatctctgcgttggactcaactatcgtcgcggtcgcgttacccacgattggcgcggactttaatgagtatcagcaaaccagttggctcgttacctcctacctgttgacctacacggcgtttcttccagtagtctccaagctcacagatatcgtggggagaaagccagttctgattgtatccactctgttctttatgttatggtccggagcgtgtggaggggccaagtcaatgacacagctcattgtgtttagggcgttgcagggaatcggaggttcagcaatctactctggcgttgtggtgacgatcagtacgattgttcctagggagaaagttggtgcatacacacccatcattgggacagttttcgccgcaagcagtgtgtcaggtccactcattggtggtgcaatcgttcagcacgtccattggggatggattttcttcgtcaacttacccatcggagctgttgcatcatctttgttgttctacgctctgagtgatccagatctcggccctatgagcatccaaaagatcagtcaaaggatagattggataggcagtttcctgttactggctgccagtgttctcctcgcgttctcgctccaagtcggaggtacagacggatatccatgggtatccgtccaagtactcgccccgctcatcatctccttctgcattctaccagtcttcgcgttcgtcgaaactcgtcacccagaacccgttattcctttacgtctattccgagtccgcaacatctgctttattttgattttcacgctggcattaggagccggtctgttctcgcatgccatcttccttccgcagcgcatgcaggtcgtagatggtgtttcacctgtcaccgccggtgttcgcatgctgccccttctccttcccgttggatgcctcagtcccttcgcaggcgccatggtcatgctgaccaaaagttaccgacctctcatgtggttcgcctcgtccatcggtgctatcggtgctggcctattgtccactgtcaccgtcccaaccaagttttcccatatttacggattcgaagccatggttggcttttctatcggtgtcaccatcaccgcgtcgaccttgatcatccagttctgcgccgagagacgagatttggcggctgctacgggcctccagacgttcattcggcaattgggtggattggttgcaattgcaatttcgacggcgattctaaatgattcggtggaaaagtctctcggcagtaatgcgcgattggccagttctccaggattgcttgaaggcattttgaagagcccgactagtgtattaccttcgctggatccggcaacgagcctcatcatacgacaagcgtatagcaaaggtttctctgtaacgtttatccaggccagtgcttggttggctgtcggagctcttgccacttttgggcttgtacattatctgcctgataggtttttggacgacgagcagaccaagggagaggttcttgatcctgagaaggctggtgcaggctcgattgacaataccatcaagactggagaaacatctggagttgcgaacgaaccggatgagccgctaggtaaagagccggcaaaggttgaagtggttgatgctgagaaaactgtagtaaactcgggtggagttgcgcacaacgaaccagatgaaccgctaggtaaagagctggcaaaggttcaagtggctgatgctgagaaagctgtagtagactcgggtgaaaaggccgctgagacaggggaaaggaacgagacggaggagaccacatcccaaaagttgtaa

SEQ ID NO: 310 - DNA, 1569 bp, Moniliophthora roreri
atgaaccggacaacaaaaaccttacttaccacagcttgcatacttgtatgccttactagaggtgctgtatctcaagctacatggaacgagtcgtcctggttgtctatcacacctactcagaacttgacctgggtgccatgctacgacggaggccttgaatgtggtcgcttccaggtcccattgaattatgccgacccagaaggacaatctgctgccatagcactcgtgcgcatgaaagccaacgtctctgccgatagtacggattatcttggtcctatcctcttcaatcccggaggacctggcggtagtggtgtcgactatatagtttcgttgggcacaaaattaagagaaatcttggggcctcagttcgatttagtgggattcgaccccagaggtgtatcgcgctccactccacgcgtgacaatctatgaaactcttgatgagcgtctgtcatggcaaaggtctggaatttgggagctcaactcctctttgcaagacaatgttgcgagttattgggctcgtgcaaagataatcgcccaacttgctgaagaacgtcatggggatttcctgccttatatcaacactgaccacacagcacgagacatgcttcgcattacggaggcttacggtagagagaagctccagtattggggcatctcatatggcacggctcttggttcgacctttgcagctatgtttccagacaaggtccaacgcttggtaatcgacggagtgcttgacgttcaagatgactactacaccatgggatggaaggatgtcgtttccgataccgatgccaccctgaagtggttcttcaaagactgccatgatgcgggagcagaaaaatgctccttctatgagtcgtcggccgaagccatcgaagaaagactcaacagattataccagtccattatccgagctccggtaccggtacgcggcgctggcctcattgattatgcatcactgcggttcgtaatattcaatgcgctgtactatccattgacccggtggtccactttggcaactgccttggccgacttggaaaagggaaatggtaccacgttggctcagatgagcgggctagtgccatcatcttcccccgattcagacgacgctccggtgtcttttgcaaacaacgatgagtctcagactgtgatagtctgcaatgacggtgacgctgtgccacctagcctggaacatgcacaacagcactatgaggagtccctgaaagtatcggaatggggtagtatgtcatcagccatgagaattaaatgcagtggttggcccaacattccaaaggcgcccttcagaggtcctatttcgggaaacacgagtcatccgatcctcctcataggaaatactgctgatcccatcacacccctctctgctgcacacaaggtttcaaaaggtttccccggatcagtcgtgcttcagcaggattgcgctggccatacttcaatcctggcagggccctcggtctgcacctataacataattcgcgagtattttgtcaacgggactctcccagagccaggcactgtgtgccctattgaaggatctccgttttaa

SEQ ID NO: 311 - DNA, 1848 bp, Moniliophthora roreri
atggaacaacctgcaaaacgtcgtcgcattcagcgctccccctctccgacatataggctcgacgacgatagtaattacgaaccgtatatcccgatagcccaaagacgacaagcaaagctcgcaaaactctcatctctgggtgcttcgacggagagagaccggaatagcaagcagagagaggaggaggaacgcgaagaagagaaccaggaagaagaacgacaaagagaaaagtcgaggaaggagagaaccttactactagaagctcaagaggtgcattccaagaaggccgctgaagacgcgaagaagactcaggaggaaaaggcacgggaagtggatgaagagatcctggaggctataaagattcgcaggaagctagcttcagacagagagctggccaaaggcatacaatataccgaatctttaaaaactagctggcgacccccaagatatattcgcgaaaagacaaaggaacagcacgaacagcttcgcgagaaataccatatcattgtagaaggagaagatgttccgcctccaatcgaacacttcagcgacatgaagatacccgactccattttgcagcatctcaagtcgaagcgcattacaaaaccgacaccaattcagcttcagggtattccgacggccttcgctgggagagatctcatcggaatagcattcacaggttcagggaaaacgctagctttctgcatgcccctgatcatgctcgcaatcgaggaagaagccaaacttcctctcgttcgaggcgaagggcccgtcggtgtcatcctatgtccatcccgagaactagcaaaccaaacctacgaaaacgtgctcacatggaccgacgctctcgctcaggacggcaaatatccacggctgaataccctgttatgtataggtggcatttccatgaatgaacaaagccatacattgagcaaaggtctgcacattgtggtggctactcctggaaggcttatcgacatgctggaaaagaagcgttttacatttaacaactgcaaatatctttgcatggacgaagccgaccggatgattgatctgggttttgaagatgatgtgcggaatattatgagctttttcaagcgtcaacgacaaacattactcttctccgcaacgatgcctcggaagatccaggattttgcgcaacaatccctcatcaaaccggttctcgtcaatgtaggccgtgctggtgctgccaacttggatgtcctgcaagtcgtcgaatacgtcaagcaagaagccaagatggtgtacttgttggagtgcctacaaaaaacacctccaccggtaatcatcttcagtgagaacaagaatgaggtcgacgatattcaagagtatctattgctcaaaggtgttgaggccgtagcgatccatggttccaagagccaagaagagcgtcaatacgctatcaagtccttcaagtcgggtgcaaaagacgtcatggtagcatccggcgtcgcctcaaaaggactcgacttcaacgatattcagcatgtcatcatcttttcgatgcctaaagaaattgaagactacgtgcatcaaatcggacgtacaggtcgtagtggaaagacgggtattgcaacgacatttgtgaatatgaatacaccggagcagacgttgttggatctcaagtatttgcttatggaggcggggcaaaaagttcctccgttccttgctactattgaggatcctcgtgctgctcaaggcggatcgttgaagggatgccccgtttgtggtggcctgggccatgggattagcaattgtcccaagcttgaggagacacagaggaggcagatggcgtcgcatcgtacgactgatgatgggggctactga

SEQ ID NO: 312 - DNA, 1248 bp, Moniliophthora roreri
atggaatcagtcagtcacctcccgtatttcttccccgacgcacagcaacagcccgagccatcgcagccgaacaccagtcgtcgtggctctgttctctcttccattctctccggaagcggttgcgtatccacttcgtctgcctccattcctccatcggcatctgggcccaaatgtggtgtgaagcgatcccgtgatgaaaccaaggacggacagcctccatctcgagacagttatctggtcattccagagcccaagcgccgtagaatccagacagatacagatttcccgcttccattttctaccacatcggcacacacagagggaaagcccacaagcacaactacctctcccccagccacacctccagagcttccttgccgtgactgggcaagcaaggttgcactgggtctctggattggtgaatatctgtgtgacagattttctacgcctgagttcaggtttgtcgaaaatcatattatcatgaaggaaatgagcgggaaactcgttagcgtcttggactacctcgacccgcacaactcgatcgctcttgccgctcttatctacctggagaggctcattcgtggcatcaaaatcggcgaaacatttagtgatcgcgatcgcgctaccatcatgtataggtcatacctactcgctctccactttgcctttatctggctagaagatattccttggtccctctcaaagatcgctgaatgcatggaagtctctctggaagacgcgagattgtgggaacaccagggtctctcattgctagactacaatctcttcattgcagaaggcatttggcccgcatggctggacatgcttcataaacatgccgcattcacggaatgtcatgaccacattggccttacgttacaagatatcttccttacagccaaggatgaatacagggcatctgtccagcacatccaagcaccttctccggcatcgtcaccatcacttccatcaccacctcacaccccgccgccgtctgctcttgctccaaaggtagcaacgactactgttcgtgagttaccaaccccgcaccctggccgttcgtcatcgctcgtcaagtcgaaggaagattgggatagtggttttgagttttccactgccagccttgagcatgcttctgctccagaccgacagccgtctctgttcgacgccactcttcctattctgcagcccaaacctgttcttcctgcccaccaacacgttgatagcttgctcatggcggttgcctag

SEQ ID NO: 313 - DNA, 1947 bp, Moniliophthora roreri
atgcttggtgtagcacgcgccggcgctcgctctcggcagaatttatttctccatcgttcgtcacgaaatccctggacaattccttcttcaactcggcatgcccggttcaactcaacttccacggaaattccaccacctaaacctcgatctaccattattcgccgggcattaaccgttgcaaaagtcactgcttatgtcggtctatcttcagtctttggccttgtcgtcgtaggtgctgggatattcattcacgacgcgtttacctacaacgaacgacacgtggaacgggtaccagtacatccattggcgttgcatccagagcgaggagggcccaagaatcttccgatagtcaaagtgcagatggatgaccaggaggatgaggagacgaggaaattggctgagaaaccaaagttggttatcgtcggtggtggttggggggctattggaacgctacgaacgcttcatccaggagactaccatgtaaccgtcgtatccgcagaaactttcaccaccttcacgccattgctaccctccgctgctgttggtaccgttcaagttcgttcacttatcgagcctattcgaaagatcattgcccgtctgcgcggacattttgttgctggaaaagctgtggacctttgcatcaaggataaactacttgaagttgaaacttggagctctaatggcactaaagagcgtatatatgtcccttacgaccacctcgttatcgcagtcggatcgacctccagtactcacggtgtccccggcctcgagaactgtttccagctcaagaccatctcagatgctcaagctatgcggagacgcatcatggacaactttgaaatcgctagtctgccgactactactcctgaagagagaaagaggctgttgagctttgtcgtttgtggtggtggtcctactggcgttgaaacagccgcggaaatatatgatttctgtcaagaggatatcatgaattacttccccaagatctgccgagaagaggtttccattcatgttatccagtctagagaacatatcctgaacacttactcggaagccatatcaaaatatgccgaggagaaatttgaacgcgatggtgtcaatctcattacgaactcacgcgtgagcgccgtaacgcctacacaagtcattttcacagcgcgagacaatgaaactggtcaaattactcaacacacggtccctaccaatttcgttctatggtcgacgggaatagcgatgaatccctttacaaagagagtcacagagttgctacccaatcaagtccataaaaaggccattgagacggatgcgcatctacgggtgaagggtgcaccggtcggagagatctatgctgtcggggattgtgctacgattgaaacttcgctcgtgagccacttcatggaattggtggacgaggcagataaagacaagaacggcaagatagatttcggagagtgggaagtaatggtcaagaggatcaagaaaaagatacccatggctgagaaccatgtcagcaaagttagagaactcttcgagatgtatgacacagattcggataacagtttaaccctcaacgaactcgtccggttgttggaagacctcgggaacaagatcaccgctttacctgctactgcgcaggtagcttctcaacaaggcaaatacatcgggaagaagctccacaggctcgctcggcaaagagagttccaacagacaagggcaatggatgttggagggacgccattcaaatatcaccatctgggcatgttggcatatattggcaacgctgctgtgtttgatttgggaccttggtcgttcacgggtggattggctgccatgtacgcgtggagaagtgtatattggaatgagcaagtgtcggctaggactagagcgttgttgatgattgattggattattcgtggtgtgtggggaagagatttatctagactctag

SEQ ID NO: 314 - DNA, 1392 bp, Acremonium sp.
atgtcttccttcattgcagagtgggccagagctcaggcgcctagagcctccatgtctagaccttcgtctgtgttcttgcgtaaccttgaagaggagctggacactagaaggcaacaggacgcactgatgatggtacataagagaggtgatgccatcgatttctcttcaggcgacatgcttggacttagggccacggatttgctgaggacaggcttcgtcaacgagcttgagcaacatcccaacttccacatcagcagcggaggatcgagattgacggatggcaactcagatgctctggaaagtttggagcaggagcttgccgagttccacgacgccgaggctgcattgttcgttctatcaggtgccatcggtaacggcgccatcttctcggtcatacctcgtccaggcgatgccattgtgtttgatgagttggctcacgccagcattcttgacggcatgaagaatagtcttgcgctatgtaaaaagacattcagacataacagcgtcgagtcctttagaagcgcgttggaggccgtcaggagaacacaaccacaaatagctgacggttcacacagcgtacttgttgctgtagagtcaatctacagcatggacggcgacacttgccctctgaaagagcttgtcgatgtggccaaagacatgtttccaagtggcaacatcgagtttgtcgtcgacgaggcttggactacgggagtcgtgggccccagaggtgcaggtatggtcgctgctctgggtctggagaaggacattgccattagactacatacgtgtggcaaagcattggctgctgctggtgcggtgataatctgtcacaatacagtcagaacgatgctgctgaactattcgagggagatccactactcatattctcccagttttccaataatagcttctgctagagcggcatactcattgatgaagacgggtcagactcaagaggcacaagttagagtgccatatttggttgagctgttccacgacacacttggttccaacccaaactgggacgaagccaacgatttgggtttgatcagaagtgctctttatgatgagtaccaagtctccccaccatcctttgtatcttgtatacagccaatccacactcgtccaggtcatcacttttatctagcctttcatctgcaactggcgggcttttcagttttcccaatatcgtacccagtagtgcccaaaggagcagatagagtgaggattattatccacgcatcaaacacagatgcgcaagtgaaagctctggcagattccatctgtgcgtgggctcaggagatgatcgagattgagaagagcggtacgaagacgagacttccatctgccgcacaccaaaccattgctctgattacgaacggttcggtctga

SEQ ID NO: 315 - DNA, 1716 bp, Acremonium sp.
atggctcttgcacacttttcgatttgggccgtcctgattccaattgctatctattccctgtatctgtggcttctaccaaaaccaatttctggaataccctacaacgaggaagcgactagaaaccttttgggtgacgttggctcgttgacaaactgggagaaaaagaggcccggcgaaatctatacatggctgttggatcaaatccatcgtcacaagtccccaattgtgcaagcattcgtttatccttttggcaagccatggttggtggtcgccgattatgttgagactgaagatgctctgttgagaagaaacgatgactttgaacagtcagagacgcaaatagtcacgttcagacaggtagtccccgaacaccacatctctttccaaaccaatgccaaattcaagcgtcatagacagatggtccaagacttgatgacgccaacctttctgcatacaattaccgcaccattactgcacgcctgcttcatggaagcaatgcatttgtgggagatcaaggcacaactggcccaggatcgtccattcgaagccaagacggatttgagcaacagcgcattggacatgacctgggccgcgttctttggtagagacacgcccatccagcagactagggccaacatcactgcactgtcagcttgcgccatcaatgacgtttcggcaagacaagacggtgcagtcgacttccctgtaccacatcatagtcccgagtttgcaagcttggtccatatttcagagtctctggagattcccatgcaatccgcgactcctgctttttcacactggctgcataggcagaccaaaccatggaaggaagcctataaactaaaggaaaaggtcattagagaagagattagcaagcgtcttcgtgccgcggaagctaatgatggtgaattcactgtgcgtaatggccttgactctatcttgagaagagaaaagatcctgtcagagagagagggcaaagttccagactacttctcgagagcaatggttgacgagagccatggattcgtcagtggcggcgccgacaccagccatacggctctggcgtggagcgtcaaaattttggcaagatatccaagaattcagtcgaaattgagagctgccatctttgcaggcttccctgcggcggcagcagaaagaagatttcctagtgccgcagaaatagccagtgccaacattccatacttggacgctgctgaggaggagttgatcagacattcaaagacagagatcagctcactaagacgtacgaagagagatatcacgcttcttggtcatagagttcccaagggcgttgacatttggtttcttggtattggtccaagctattttgagcccgcacacaatatacccgactcgatgcgtagccccacagctagagcagcgaagagcaaggtaggcgcatgggacccaagagacattggcgagttcaaaccagagagatggctggtcagggataccgatggcaaggagacgtacgacccatcggcgggcccacatttgacgtttggcctgggcgtcaggggttgctggggtagaaggatggcctacttggttgtgaagattggtcttgtgctgatgctttggaactttgagtttctgcccatcccagagcatttggatggtgaattggctagagatggtgcatcgcactcgccacagcagtgctatgtaagagtgaagaaggtagacttatga

SEQ ID NO: 316 - DNA, 7293 bp, Acremonium sp.
atgaacggatatcaaattcccaagcctaatgaggcattgaatggcgatactgtcatgagtcaaagagacttccccatcgctatatgtggcatggcgcttcgtctgcctggcggtctggagactccacagcagctgtgggattttttaatagccaagaaagacgcccgttcgagagtacctgagtcgcgttataacatatcatcctattactctggcgtcaagcagagaggtgccgttgcagcggaatacggctatttcctggatgatggcatcaagcttggtgcgtttgacgcgtctagattctccttcaaccgtggtgagttggaggcagccgacccccagcatagactgatgttggaggtggtcagagaatgccttgatgatgcgggtgaagtcaacttcaaaggtaagccaattggctgttacatgggctgctacggtgaggactggctagagatgcaaaacaaagaccctctgcaaactggtagcaatagagtcgacggctatggtgacttcatgctgtctaacagagtctcttacgagatggacttgagaggtcctagcatgaccatcagaacggcctgttcatcagctctagttggcttgcacgaggcggccgtggccattcaaagaggtgaatgcgactcggccattattggcggatccaacttgatcctaacgccacgtgcgacggccttcatgaacgagagaggtgttttgtcccccgatggatcgtgcaaaactttctcggcagatgcgaatggttatgtcagagcagaaggcgtccttgcagtgtatatcaagccatttgaggctgctgttagagacggcaacccaatcagagctgtcatcagatccaccatgaccaatagcgacggtaagactccaggtataactcatccaggtaccgacacccaggaggctcttatcagaaaggcatatagagcagctggtatcgaggacttctccaaaaccgcatttgtcgaatgccacggaacgggcacttcggttggcgaccccgtggaggtcggtgctgtcgctagagtctttggagacactggagtccatattggctcggtgaaacccaatctgggccactccgaaggtgcctctggtcttacatctttgataaaagctgtgcttgcacttgaacacagaactatcccaccaaacatcaaattttcgagcccaaatccaaagataccctttcaagagaggaagttgactgttcccactgagccaacattgtggccagagtctagacacgagagagtcagtgtcaattctttcggtgttggcggtactaacgcacacctgatattggactcggctgccagtttcaacgtatcctcgtctggttcgggcacccgtgtcggagacgatccacagctgttactattctctgccagtacatctgcatctttgcaaagcatgtcgcaggttatgcaaagttgggctgctgataacgcggactgccttgaggatatggcgtatacccttgcaaacaggagggaacatctggcgcacagaagcttcatggtaactcgtaaatataggccaggcaccgcgtctgcaggtaggagaatagcgaatccaccatccaatttggccatggtcttcaccggtcaaggcgcccagtggccacgtatgggaagacagctgctgttgagatcggatatgtgctttagaaaaaccattgagtcccttgacaggtatcttcaggagatacccggtggtcctgagtggacattggtggaggagctgctgaagccagcaaagctgtcgggtatggagagggcggaattgtcccagcctctgtgcaccgccgtgcagattggcctggtcgatttgttcgcggctgtcggtgtgaagccttcagcggttgttggacatagtagtggtgagatcgcagcagcgtacgcaaccggagctttgactgccagagaagctattgtgacgtcttggcgtcgtggcgtagccgccaaggctcagtccaagcccggtgcgatggctgctgttggtttgggttgggatgatgtttctggaacggatggtgctcgtgtcatcgtggcttgcgagaactctcccaagagtgtcaccctttctggtgatgctaatcaggtcgaaagcacactggcgcagatcaagcaggcgcatcctgatattgtggcaagactattgaaggttaacaaggcgtatcactcgcaccatatgcgtgaaattggcgccgagtaccatgctacgatcagagatgagatagtcggcaagctgcctagaaaacctttcttctccagcgtgaccggaaaaaaagaagagggtttgcttcttgatgccaggtactggcaaacaaaccttgagtctcctgttctgttcagatcagccgtctcggagatgctggagcaggaagaagacttggtctttttggagatcggacctcacccagcccttgccggaccagtgagacagatcttgggagaggcggcgatctcagcaccctatgtaggtgccatgaaaagaaacgaagattctgtggtttcattcctagaggctttgggaaacttgttcgagctaggcattttcgtaaacttcgcggcccttttgcccattggcagatgtctgccagatctgcccagatacccctgggaccatcagagcaactactggcaggaaaccaggatctcacagcagtggagagcaagtcaattctccaagcatcctcttttgggcacaagaacgttggaaagcaccgatattgagcctgtctggagaaacttgttgcatgttgacgaggtcgattgggtcaaggaccacaagattgacgagagcattgttttgccagccgcaggttacatagccatggtcggcgaagcggtgagacagattagcggagtacaagagggtttcgctctgcgtcgtgtggtgttgaatgccgctctggttttgccagaccaaaggcctaccgaattagtcactacgttccatccacatagactaactgagactttggatagtcagtggtgggacttcacgatcgcgtcatacaatggccaagcgtggaccaagcattgttttggtcaggcctcaggcgacatcccaaagtcgattgagacttttgctctgccatgtccattgccaagaatctttgaccaaagaagatactacgaatacttggacaaagccggcatccagttcggtccacactttagacttttgacagatctaagaaccggctcgattgagcgtgtaggtacggcgggaatcagggacgagctgagaggagatgacgagagatattgtgtccatccaacgatcatcgatggatgcatccaactagcagctcctgctgctctgaaagcagacactgacttgaagagatacagggttgtaccaaccaagatcgaccatgtcactgtacatagatgcccttccaaagccaaattgagcgcgtcctgttcagcgtcgtacatggaaggcagtggccaggcaaaaagcaaagtgcaacaggtcgttgctgatggccatgttgtcatgcatatggaaggtttagagctttctcccctgggccaggccgacaagaccgaaatcgacagtattccagcggcgttgctgaaatggaggccacagatcgacttcttggatccatctgagttgattaagcccgagatccctagacacatatacactccacttttgaaccagctggtacagctgtgccttgtgtactcccatcgtcacattaaagatactcaaacagcgacatctcatctgaaaaaataccaagcctggatggagcaccaagtacacgtcatcgaggcagtcgaaaataccaaaatggtacctttggacgacaccaccatcatgaataaggtggcgcttttggtccacgaaatggcagacagtccagttgctgcatgcgcaatcgccatacaaaaggtcgtcttgaatatagtcgcactgttttctgccgaattggaaccacttgaactacttttggctgatgacacgctttaccaactatatagatccacagactccattgacaggtcgcaattcgtcagacatttggcccacagtaagccaaatttgcgtgtcctagaagtaggcgccggcacaggcggtacgacagccagcatgttggaatatttggcggattccgaatctagcgaattgcccatgtattccaagtatacttatacggatatttcggctggtttttttgcctccgccaaggaaagattcaaaaattatagacaaatcgagtatagaacacttgacataagtaaggatcccgctgagcaaggcttcacggagagcgacaagtacgatttgattctggcaacaaatgtaattcacgcgacgaagagcttacaggaaagcttgagaaatgtctatcagttgttggctgacgatggcagactgctgcttcacgagttgaactcggaatcgaaatggcccaactacatctttggtttgttgccaggctggtggtacggcgagcaggatggtagatcgaatgagccatatgtggatccagccagatggggtgaggaattgaagcaagctggattccctggactggacgccgtcatactggacgcggccgagccatatcagctgaacgccatcatggtcgcgaggagacagagccacgcagctcagacgcctttgaaagccgccaccattatttgcgacgacaatgttgatctagccatctctttgtcgcagcagctgcaagatagaggatatacagtgcatagaagaagagtcggcgaagcccttccagactccacagatagcattgcgttgctggactttgaaagaccttggttcgacagcatggacgaaagctccatcaaagcgttgcaaagccttttcgacagtttgggaaattctggaatcttatgggtgactagaccttgccaagttcagggtcgtgatccaagatatgctcaggtcatcggtgccgccagatcaataagagccgaaacgctggtggatttcgcaacgtgtgaagtcgacgacaccaaaacgtctcaagacagaataactgatgttttctccaagtttcagtcaagaaaagaagacgaaacccttagaccagattacgagtacgcaattgtcaatggaaccatacatgtgggcaggatctatcccatttcgatgaacaacggcccatcgttacttgctagccctgatgacagtatcgttctaaatgtcgcaaagcctggtagattggcatccgccagatgggttgctcaacacgtgccacctttaaaaggacacgatgtggaaatccagtttcacgctgtaggcctgaacttcaaggatgtcttgggtgctttgggcattgtcccatatcccgaggcaggcttaggcgcggaagcggctggtgtcatcactcgtgttggagcagaagtgcagagattgcgtcctggcgacagagttgtatgcctatgcatgggtacaatgtcgacccgtatggtcgtttccgaggatacgtgcgcaaagatgccagaaagcttgactttcacagaagctgccacaattccagtggtttttgcaacagcggtgggctctctggtcgatatcggcggactaagagaaggacagtccgttcttatccacagcgcctgcggcggtgttggccttgctgctttgcaagttgcaaagatggtgggtgctgaaatatacgcgactgtcggcagcgaggataagattgaatacttgaccaaggtatttggtctagccaggaacagaattttcaactcaagagattcaagttttgagcaagatcttctgagagaaaccaacggcaaaggcgttgatctggccctgaactcattgtctggcgagcttttacactcgacatggcgttgcgtggcccaattcggacagatggtcgagattggtatgagagacttgctgggagctggtaagttggacatggacgtcttcctgggtggccagagtaagtgcatgcgtttgaaatggctgttgagtttgtctgcttacgtcttgtccttcagattactagaaaggatcatgacgtatctggagagtggcttgatcggtccaattagacccatgcagacatttgacgctggtgaagttgaagatgccttcagattcatgcaatcaggtcaacacttgggcaagattgtcatatcactaagagatgagaagggttccatgaagttggatacagcctccgtcaaatcactaaagacgctgaaccttgactcttcggcatcttacctgatggttggtggtttgggtggcttgggaaaatctgtggcgagaaacttggtagagaagggtgcgcgtagactagtcttcttatccaggaatgcaggtaccagtcctgatgatcatgactttatcggagagttggaaagcatgggctgcagcgtcaacctagtcaaaggtagcgtgaccagcaaggatgacgtgataagagcgatctcagaagcttcgaatctgaaaggcatcatgcaatgctccatggtacttagggaccaggctttcgccaagatgactttgaccgaatggcaagaagccactgcacccaaagtcgagggaacgtggcatctacacaacatcacgacggaagccaacattcaattggattttttcgtgttgttctcttccatgtcgggagccgtaggccaagccggtcaggccaactacgctggagcaaataccttcttggactcgttcgtccaatacaggaggaacttgggcttggctgcttctgcgttggacattggacccgttcaagatgtcggttacttgtcgaaaaatgacgcgttgctgaagagaatgacacagcaggctgcgcattccataaccgaggccgagcttctgaaatcagtcgaggtagcgatgtcattgtctgcggcgcctgaggagcttattgagacacccgctaaggatggctttgtggacagcagtacaatcttgcttggcttgggtacatcgtttgccgccgacaactctgccagcaaaacctttttcaagaaagacaggagactagcagtttatcagaatgccagcgcggatgctgaagtaggcaatagtgtcaactcgggcagcaataatctgaagagtttcttgatgagcgcaaagagcgatactagcatgctgaaaaggaacgacgccatctccttccttgcaaatgagatcggcaggatgctttttacattcctgttgaaatcggacgaggagctgaacacgtctgtcgcactttcgtcattgggcatggactcgctggttgctgtcgagatgagaaattga

SEQ ID NO: 317 - DNA, 2367 bp, Acremonium sp.
atgagactttgcggtttggtcccaaagttgtttgtgttgcttttccctggcttctcggtcgcaacgaaacccaaccaagccagctgcaatgacgccctgctagaggcctatagcgaagtgtccttcgctggtccaggctttggagactactgtgtttcgttttgcaataacagcttgaagcttacgtctgtcttcgcagcagagaagatatattgccaagtctccaacttggatggtgtaatcgaaaccgccaaggctttctgcgaaatcgtgttgatagacgccgaaacgctgatcgagcaagctgctgctaatgtgaccgagtccttcattaacaagctaccagttgttggtcagggtcaatactcgccagccgagaacatctcgcatccctttttgattgccaagccatggttcgaagtggcataccgtacaaccgtaaaccttaccgtgttgaaactgacggaagatagatgggccatatttggattctggagcattgtactactgacaggaatgttgaccagggccattacactatatgaggaaagaaaaatatgcagaaaggtatttggcactgaggaagttattccctccagagcagcctcacatccacccgtatacgctttctggcaattttggaagacacattgtaaaattaccagtgcgttcaggggttatcatcagagaatattgatgggatgcacgataccagcgcgtgcgcagacaatcgagctgtttagtttctggtctttgaaccttattttgtgttgtgttgactatagaggttttgccggcaatttataccatcccgaagtctcgcagcagacatggagatatatggcagatagaacaggcatcctttcgtttgcaaatcttcccttactgtggctgttcacaggcagaaacaacgtattcatctgggcaactggatggtccttctctacgttcaatttgtttcatagacatattgcaagaatagccacgctacaggccatcgtgcactcaattgcttacaccttattctacttagagtatgacagcggatgtggttttgtaccaaacacgagtggctcatggacccttttgctaatggcaacaatctccatgagtttgcttgtcggcttcagtttcttgtggtttagaaggcatgcgtatgagttgttcctgagaattcacattgctctatccataattaccattgttggcttattttatcacgtggacatatttgacggagcgtacaacggttacctatggccacctgttgccatttggtcattcgaaagaacggtcaggttggctagggttgtgctttgcaatgtatatgtttggatcaatcatggccaatctcttcatcatgcaatgtccgtagctcactacgatgaagtgggcgaggtcttgcgtttgagacttcccatggaccagaagctgtttaaaccaggcccaggtcagcatttcttcctttaccagccattcagatggagaggttcagagaaccatccattcgccttggcgtactgggatcaagcctgcgagccccaggcagatcctgtgccctccacttctgacaaaatgagcccagttacgaaacagaacaggatgtcttctagacacggcattccattgttagtgagcaatgctggaaaggaaaatcttggcataagctatgagttcagagttcgaccacgtgatggctggactagatcccttagagatagatgtctgcgtgctgaaaatagacaaatagcctctacaatattgatggagggcccatacggccaccatcaggctctttggaagtacgatgttgtgcttttgattgccggaggttccagaattgctgccatggtaccttatattttggaccatgttagccgtggtcaaagaaaagcaatacaggctggcaaggtgaaattgatatgggcaaatagaaatgaggcttacatgagaagcttggcgagacaagagctttctagcggtttcagttgcgaaaatgtctccggatccttccacgccaccagatcacctgttgctgtgccaaacactttcgttgcggacaccagaaccatggaggagaatcagaccagcaataacaagcaaagtggaacccaatcgacagacgagatttcctcaaatgagagtttggctgccacgcaaagtattgtcgctgtcagcttgggcagacccgatataaagggtttgatcgacgcggcagccactgaagccacgatttctcactgtagccttgctgtaatggcttgcggtccagcgtcaatgacgaatactgcaagagcggctaccaataatgctatgatgagatgccatggtcaaattgaatactttgaggaagaattcggttggtag

SEQ ID NO: 318 - DNA, 1338 bp, Acremonium sp.
atggcaactgcatataatatcactttgaattcagacaacaccggtttgtggaaaattaagcagactaggagtgctgccgaagtagcatctgagttacttcaagatgatctggagaaacatcatgtcattttcaatgacagaggattccataaccatgtgccacatcaaattcttgcgttgtttggaaccggagcaccaccagatgtacttaagaagagatattatgaacactcaatctaccagttgccattgcagccagcctccggtctagttgttgagaggttgttgaccacatccgattgggccgacgctgctccttttctaggcgaacccgaccattatccatcctttttgcaattctttcaaaatcaggtcagtgaagatggttggcaagacgtggtgcagaagtacctttttgctggaggaagattggcggacgatatgttggcccgtttgcacggcgcgattctgcacccattgattcagttgatgtatggagttgaatggtcgcaaccagcgatcgtggccgaagcacttgcacagacagctgtgcataaagaggagaaattaaagcaattcttgttcgattctgagaaagaatcaaaagctacaacagagaaaatgccatcaatactggacctgtaccgtatggttgctgaaaacaaaaaattggccgaatgcgtgaaaatcgacgatgatcacacaaattataactcgataatgaaatgcgcgcgtgctgaagccctagctatcgcagctagggtgcacgttaagccagaggatttggacgaaagaacagcagagatgtttcaggatgtattgtgtgtcagtgccgctggtgccatctatccaaagaaatatcccaagtttgacttctacttcattcataacgtcaactcgtgccctttctatcctatggtgaattcgctgacatgggtttctccagagatcaaagtcagacttctggaatggaaaataagactagatttgttgatgtacgcagccggtggctgtccatccttggatttcacttgcatcaagtcctatgaaactatcggttctcatcccgcgggctccccagaaagaattttgtcagtgcttcatcttattccagacgatggtcatgctatgaaattgggtagagcctcttggatatgcgaggatatatgcaaactatatgaagagaaagactgggcaataatcagcggccatgatgcatggctgaagatctatcatttaatcgtcgactccgttgaggcaccaggtttgtgggtgagaggatgcggctttgaagatgcatggaagggtgtccctgacctgcctggccctaatgcctaa

SEQ ID NO: 319 - DNA, 771 bp, Aspergillus niger
atgacaatcctctgtctacatggcggcttcggcagcgcccaaaacttccaagtgcaactccatcccctagttagtacctaccaatcattataccccgataccaccttccactacattaatggcggtcatcccgccacgcctccaccaggaagcgaggattacttcggcccaccgcctcattaccgattcatcgaatacgatgggattgggcggtccgacgatgtgatggagcggattcgtcagctcccgaggggagccacggccgaagataccatgcgggtgttgacccacgaacatgagatgatgtctgccgattgtgtgagagaggcgttgcagagactgttggggatattggatgaacatccggaaattgacggagtcttgggcttctcggagggcgctacagtcgctgctactttgttgcttgaagaggagcgacttgttcaggaggagggtaggaagagacagcttaagtacggggtcttcatagcaggctggcctccccttcgtattgacggcgatcgagtaacaggctgtctggcggatgagacagaggatatgatcgaagtgccgacgtgtcatatcatcggggcgaatgacccctacgtggatggcaccatggcgctgtatggggtttgtgatcccgatacggccatcatgtttgatcatggcaagggccataccattccgcgggacgtggcgacgatgaaggaggcggcagaggtgattgagcagaccaggagacgggggattgctgccggggatgcgtag

SEQ ID NO: 320 - DNA, 6795 bp, Aspergillus niger
atgcataaccgagcttccgcattaacctcagatacagccgccataatgactatcacgaacagttcgcaggcgccgattgcaattgtaggcatgtcctgtcgccttccaggccaggttcgtacgcttgatgacttctggactctcatatctcgcggtagggatgcttggggccctatcccttctgatcgcatgtccagtgcggcctactaccacccagatccccagcgaaagggctgtttcaaccccaaagggggttattaccttcaggaggatttctctcagtttgacgctccgttcttccacataacgcaacaagaagccattgccatggatccccaacagcgactactactcgaatgtgcctatgaagccctggaaaacgccggttttccccaacaagccacggcaggctcgcgcatgggggtcttcacgagcctttgttcatcagactaccgtcgtggtgcttttcgcgacctggactccgttcccatttttgacgccacggggaatcaggaatctatccaagcgggtcgcctttcccatttcttcaacctccgtggcccatgtatggcgatcgatacggcctgttcgtccagtctctatgccctgcatctggcggtgcagagtattcgttctggcgatgcggattcagccctggttggtggagctagactgcgtttgcagccagatgagatggtttcaatgtcgatgatgggtttatacaacgagcaaggaaaaacctttgcatttgatgatcgtgccgtttcgggctttgcctgcggtgagggagtgggctgtcttgtcctcaagccattagaccaggccctggaagacaacgatccgatctattcagttattaggaacacaggggcaaatcatgatggtcgaactgtcggcatgacgaaccccaacggagacgctcaagaagaactcatgcgagaagtctacgcccgcgccgacctctccccgattgataccggattcgttgaggcgcacggcaccggaaccaaggttggcgatcccatcgaagtcggcgccatccatcgggtgtttggggatggccggaccaagcgggcaccgctatacctaggctccgtcaaatccaacttcggacatctcgagtgcgccagcggtattgcgtccgtgatcaaagcgtctctgatgctccaccgtggcttcgttcttcccaatgccaactttgagcgcgccaatcccgccatccctcttgaccaatggaatatcaaggtgccgaccaatctgcgcccctggccccagggcaagaagtacatcagtatcaacaacttcagcttcggtggctccaactgccacgtcgtactggaacggcctccccgttcgcgcggccagcctcccaacccccaacacgatgcgccccagctctttgtactcagcggctatgatgacgaggctgcgaaacgcattgccaggaacctcacgttctacttggaacaacatcccggtgtcttcgaacggcgcctggtgcacgatatcgcatatacacttggcgagcgacgctctcactttccctggcgcgttgctgtcaccgcttcatctaccgcggaacttgtcgagaccctgaatgggccagcgagtgtccctcagcgcgcccggctggaggctggctctgcacctgttattgcctttgcgtacactggacagggcgcacaatggccccgcatgggattggaacttagcgacacccaccctatttttgctgccaccatggaggaagcagcacgcgcactggaggatctgcgagcggatttctccctgttcgaagagctgaagcgtgaggcagctgactctcgcgtcagtcagccccagatctctcaagtagtttgcactgccgtgcagcttgccctgacggatcttttggcttcctggggcgtacaaccgcaaatggttgtcggccactccagcggagagattggggcggcctatgcggtgggtgctatttccgtgagcgaggccattgccctggcatatcatcggggtcgactcgctgcccaggttcgaatccgattcccaacgttgaatggttgcatgatggccgtcggagagagtgccgatgaggtgcgcaaaaccatcaagcaacttcagctaggagaggacatcactgtcgcttgtgagaattcacctcggtccaccacggcgtctggagatgccactgccatggaccttctcgcaaaggagctggaagcgcgacagatctttcatcggaagcttatggtcgacgttgcctatcactctccccacatgcagctgatcgccgatgagtataccagcgccatccagcaggtcgcaccatccactaagagggagaatgtccagtactactcctcgctgttaggtgaaaagatcgagcaacccggggctctgggagcatcgtattgggttgataacctgacgcacccggtccgattctctaccgcgctgggccagctgtgcgctgagtccagacccgatatcatcattgagatcggtccgcattccgcgttgcagggcccgatcaagcagatactgcagggcatccagaatacgcacactcaatactttgcctcccttgtccgcaaggagcacgccactaaggctgctctacagctcgcgggccggttgttcatggccggccagcagctggctttccgtgaggttaaccaaactcacctggatcagtcagtcccaacagtgttgccgtccctgacgccgtatccctggtctcatcgctcctactggcatgagagccgcatcgccgtcaaccaccgactgccacgcttccctcgtcacgacctgcttggacgattggaagcctctacccgcgaggatgaacagcccgtctggcgcaattccgtgtctctggacagcgtgccatggctccgcggtcatcgtatgcaatccatgaccaccttcccaatggccggctacatcagcatggccgtcgaggcggcatctcaacgggctcagctcagaggcctctccccgtcccagattgccgggtaccggctccgtgagttccatgcttcctcggcgttcaccctggaggagaacgtcgagtacgaaacctggctctctctgagctcgttcacggagggcacccgctcctactccagcgaatgggacgaatttcgtattgcctcgtgggcggccggtcggggttggcgtgagcattgccgtggtctcgtgggcatccggcgccaggagtcgtccactactaaccctgttagtcaacgccggccgtttcatgctagcctggagcggcgtgaggacgctaaacagggtgaccaccgtcctgtatcactaaagactttctactcagacctagagggccgcggagccggatacagcgacgcgttcacgctcgattcagacagcggggtgaccgttggaagagcaggcgtcgggaacagctggtatgcgcgcggaaaggttacagttcccaacaccgcgcaaagcatgccctcaggccatgagaccccgtttattgtgtctcctgcgttcctggatctatttttccagttgtccttccccgttttgcgggcggactctgccaacattccgtgcctcttcatgccgacttctatccgggagatcaatatcgcagccaatttcccatcgcaaccgggagaaacggcggaggccctagtcaatggactgccggcagattcctcccgtcctcggccattggactatacccttgatgcatggtctccgtctgcgtccacagagcaacccgtcctcactatccaagggttccgaatgacccctgtcaatggcgatatgctgattgacaccaccccgtatccgtggtgctacactgtacagtgggagccactgccttctgcaggtgaagcaaatggcacggcccaaagtgtcccagagagtaatggacatggcgagacgaatggcaatggcattgtgcatgcgaacggcaatgatgttgttcatggcaatggcaatcacaatgcatctaatggaagctgccatgtgtcatcagaagacgagtcaaccgtcatcatcatcactgagaggcccagctctgatccacttatcgccactctcctgacagctattgatgccttcacggggtacagaaccacggtcgcccccctctctcgcgtccagatctcgtccaaggatcgatacatctgcctggctgagctcgatactccacttctgcagtcactgaccccggaatccttcaaacatgtccaagagctcctcgtcacgtgctcctactgcctctgggttacctccggcgcatacatggctgtcgatcatcccgagctaaacattgttcaaggtctgctgcgttctgtgcgttcagaaaccggaaactcagctgtcagccttgacctggatcctagttctcgccaagacatcgcaggtcgggctcatctaatccttgatgccttcaaagcgtccaccaacgctgtccagacagccgccgatgacgaggaggaagcgcctctatccgattatgagttcaccgaagtcggtggacgcctgatggtccctcgcctagtagagcattcagaattgaacaataccgtgtttcaagagacacacccatctcttccgtacattcaggacttcgaacaaggaacggatcgccgactcaagattgccgtcggcaccctgggcgccctggactcactctactggaccgatgatccggcccagccgctcggcgccgacgagatcgagatcaaggtggcctgcacaggcgccaacttcaaggatgtggtaattgccatgggccaggtcgccagtccttacttgggcatcgagtgcagtggcacggtggcgcgcgtcggagccaaggtcagttccctcaagcccggagaccgcgtatgcgccatgtcccacggcgcgtatagcacctacgcgcggtgtccggcaaccagcgcggctgtgatcccagactcaatggactttgagacggcagcttccatccccgttacctacagcacggcttactatggacttgtcgagttggctcacatggaagatggggaaagtgtcctcatccacgccgcggcgggaggcgtcggtcaagccgccattcagctggctcagctaatgggagccgagatctacgccacggttggtagtgaggagaagaagcagatgctgatcgatcgatactgtatcccggcgagtcgcattttctatagtcgcaacaccgagtttggcccttgtgtccgcgaagccacgggcggacgcggcgtggacgtggttctgaactcactggcgggcgatttcctgcgcgagacgtgggattgtctggctccgtttggacggttcattgagattggaaaacgggatattacttccaatactcggctggagatgggcaagttcgagtacaactgcacgttttcctccttggacttgacgcttgttgcggaccagaagggcaaggtcctcaaccgtgtatttaccgctgtcatgaggatgttcgcacagggaagactgaccccggtatatccagtgacgacggtaggtatcgcggaggtggaatcggtgctgcgcaagttgcagagtggcaagacgacgggcaaggtcgtagtggatcatcggattaatgggaagatcaaggccacacatcccctaccgtcgagtgatctactttcaccggatgctacgtacattgttgtcggtggcaccggcggtattggccaatcgatcactcgcagaatggttcagcgcggtgctaggcatattgtcctgctctctcgcagtggcgccgtcacggaagccgcccagaaaatcatcagcgacggccaagccgtggatgcatcgatccagatcaaaaaatgcgatgtgtccgaagtttctcaggtcaagtcactgattgcagaactacagaaagagctaccaccagtccggggtgttattcacgcggccatggtcctcaaggacgttttcctggagcaaatgacattcccagactgggaagccgtcctccgtcccaaggtcgcggcagcctggaacctccactacgcgcttctccaccaaccactggacttcttcgtcatgctttcctccgtgtctggcatcgtcggcagtcgcggccaagccgcctacgcagcgggaaactgcttcctggatgcattggcacgctaccgccgccaaaagggcctatccgccgtatccattgacttgacggcagtaggcgacatcggggtattctcggaagcagcagacaagaaaaaggcagaagtgctgaggaacctggcgatgagcaacacaatgcgagaagttgaagtactagctctgatcgagctcgcgatgaagggccagcaagtcccagaacagtgcatcaccggtgtgcattggccttcctccgccgcaactccgtactatgcttctgatgcccgcttcacccatcttgtcgagaccgcgaagcaggaggaaggcgctgatgccacggcccatgccggagcaactaaatctctctctatcacccagcaagtccgccgcgccgcgaacctgcaggaagccctcgatgttacggcggtcggtctacgtgataagttgggtgacattctcatgcttccccgagaagtggtggaagcgcatacgcagtcgactcccattgcgtcgtttgggctggattcattgaatgcaattgagctgaggaattggattggcaaggagctgaaggggcatttgcaggttttggagttgttgtcggcgggaactttggggtcgttggcgttggtggtgttgaagaagtcgagtttggagggggcgtggaagggagaaatcccaaactaa

SEQ ID NO: 321 - DNA, 2043 bp, Aspergillus niger
atgcggtctctgcaggttttcgccctggcaggcgtccttggcgcgtctgcccttgatgccgactctatcctgagcaaatactttggcaacgatgctccttggtatagcgatcgcattcccctcttcgagacagatctctccgacattcaagatgtctactattaccgctggagcattttccgggctcaccagcgtgaccttggctcctacggctatatctccaccgagttcctcaacgacgtcagctggcaggaagaaccttatgccctgctgattgatgcctccaacttccatctgcgcgaaggccgctggtgccgcgaccgtcgcttcaccagcgactactcgtcttttctcttcggcccccatggcgccccctaccaattctccgaatccatggccgacggcgtctggcaggcctacctggtcaacggcgtcgctgacgatgccactcccctgctgtcctccatgcagaccgtctacgccggctggaactccacctctctcggtgtcggtggctacgacacctccaagggcctctactggatccagcctctgactgatgcgaccgaatacaccattgccagcatcgacgcctccgggggggaagacggcttcaccggcggatatgccttccgtcccagcatcaacagctaccaatatgctaatgccctggctattgcccacatcgccaacctcaccggcgacactaccgtccgcgagcaatacacccagctcgcaagcgccctcaagacccgtctccaggacgacctctggaacagcaccttcgagcacttcatcgaccggtacaaggaagacaacgactacgtgacctactgggacttcatccgcggccgcgaacttgtcggctacgtcccttggacacatgacctcccggacgacaacaccacctacgccaacgcatggactcacatcctcaactcctcacagctagcaggcgagcacggccttcgcaccaacgaacccagctaccaatactacatggtccagtaccgctatgacggctccaacccggagtgccagtggaacggccccgcctggccctatcaaaccacgcaagtcctcaccggcctcgccaacctcctggaccactaccccaaaaccgccgcaacaggcgtcatcaccaccacagactacaccaacatcctcctccagtacgccaagctacactacaaccccgcccgcggcggtgtccttgacatcgaagaggactactactctgacacgggcagccctatcgtcggcctgccccgctccccgcactacttccactcgggcttcgtcgacctcattctctcgggctacgtgggcatccgacctcgcgcggacaatgtcctggaagttaacccccaagcggacgcttcggcagtgagctacttccgctccgagcgcatcatctaccacggccacgaggtcgccgtgcaatgggacgccacaggcagtcgatacggcaccgtgggccttctcgtcgaagtcgacggcgaaaccgtggccaccagcaagaccctcacccgtctcacggttgagttaagctccgcttccgccccggcagtctcccgtcccatcgccgtctcggtgcaactcgccgctgatagcgagtatccgcggggtagtgtatctgtggcagacgccgacacggacgccgtgcactcagccatcgacggccgggtctggttctattggatcgaggacgtagccaatgggtgggatagtcccgttgggaatgggacggaggtgtggtaccaggtggaatttgagaatgcgaccagcacagcaagtgcggagattgcgttctttgcgaatagtacgcaggggtatgatgtgccggggagctatcgggtggaaacgagcgattcgacgaccggggagtggaaggaggtgagcaatgggaattatagctcggcggtggcgaatggaataacgacggtgagctgggatgaggtgacgacggaggcgttgaggttggtgttcacgcctaagacgggggagatggtgcggttggtggagtggaaggtgtttgggtag

SEQ ID NO: 322 - DNA, 3111 bp, Aspergillus niger
atggctaccacccccggacaacgtctcttccctgtggtcgtcgaccacctcgcccagaccaacccagctcagcgcatcggtctcatccccaagggtgctgatgtctctgatggctatgatactgtgaccgtccagcgtctggcccgcgcggtgaatgtctttgcttggtggattgagaagcagatcggacgcgcccagaagccagagaccattgcttacatggctagcaatgatgtgcgatacttgattttcctcttggccgctcataagacgggatacaagcccctcctcccctctactcgtctttccgacgacgcctaccagcacatcctcaacgccaccgactgccacgccttcttctacacccccgaaaagcagcgccgcgtgtctgaaattcaggccttccgtccggatactgccttccatgaggtgccctctatcgcagagcttttcagcaccactgctcagccctacccctacaccaagacctaccaggaagcggaggacgatgtcgccatcatcatccacagctccggcacaacaggcatgcctaaacccgtccccctgacgcacggcttcctcgccaccctcgactacggcgcatacatttcgcgtccccaatcccgccaatccaccatgttcaacgacctccagcccgacaccctcgtcctctccaccacccccttcttccaccttatgggtctgctcgccttcgccgaatccctcttccaccacatcccctttgtcgttctccccgacaagcctctctccgccgacctcctcacctccgtcatcaccgccaccaagcccgcggccgccatgctgcccccttcccttctcgaagacatgtcccacgtcccagctgcccgcgccgcactcagcaccctcgaaaatgtctacttcgctggcgcccctctctccccggaagtcggcgatgatctgtcccagctgaccaagatcatcactgtcatcggatccagcgaaatgggcctgatctcctcgttcgtgccccaaggcacaaatgtgtggggctacttcgactggaaccccgcctacggagtagacatgcgacatgtcagcgacgatatgtatgagcttatcatcccccgccgcgcaaacagtcgccgaattcatggcatcttccacaccttcccagaccgctccgagtaccgctccaacgacctcttcacccgacaccccgagcaccctcacctgtggaaataccacggccgacttgacgacgtgatcgttctcagcaacggcgagaaactgaaccccgtcaccctggagaagatcgtcgaggggcacccgcgcgtgcagcgggctctgctcatcggccaagcccgcttcgacacggccctcatcatcgaacccaacagggctctcgagggcgagaacatcgacgaaaaagcctttatcgagagcatttggcccaccgtggagcgcgcgaacgaagccgtccccaaatacggccgcatcgcaaagaccaggatccgtctctctgaccccaagaagcccttccaactgacccccaagggcaccacgaagcgccacgccgtgaacaaggactacaaagacgagatcgacgccatctacgcagcagccgaggaagaatcagccgccgtcgagctccctaccaccctcaccaccgacaacctccgcactttcgtccgctccctcatcgccaacctcctcgaccgcactgacctccgcgacgacgaggacctctacgccgccggcctggactcgctgcaaaccatccagctcgccaaaacccttaacaaggccgtcgtcgccgccggctaccccgccggtcacgacatctcccagcagcaaatctatgccaacccctccgtatcccagctcgctgcgtacctacacgacctagtgaccggcaacctgcgcacaacgaccatctcccgcgccgaccgcatcgccgccaccatcgacaaatacaccaccaagctcccgcgccgcaccacgcccgccgtccctgccccggccaactccaccgtgatcctcaccggctcgaccgggtcgctgggaacctacctcctacacagcctgctcaccgacccaaagatcgcaaaagtctactgcttcaaccggtccgatgcggccgagcgccaacagcgcagcttcgccgacaagggtctggatactgcgctgctcaaccccagccgggtggaattcctcactgtgtcatttggcgcgccccgcttcggcctgagtgagaccaagtacgccgatctcctggagaccgtggacttcattatccacaacgcatggaaagtcaacttcaatcacccgctggagtcgttcgaggacccgcatatcaagggcgtggtggagtttatttccttcagtgtgaggagcaagtacaacgcacacttgtcgttcgtgtccagtgtgagtaccatcggtggatggacggagaagttgggccccgtggtgccggagacgccggtggagagtgtcgatgcggtgctggtgcaggggtacggcgagtcgaagttcgtcggggagaggttgtgtctggctgcgtcggaggggatgggtgtgcccacgacggtgtttagggttgggcagatttccgggccgacgactgagaagggcatgtggaatttggatgagtgggtgcctacgttggtgaagaccagtaaggcggttggaaaggtgccggcggatttgggtgggtatgaggttgattgggtgcctgttgataccctctccaccatcaccaccgaactcatgcacacccgtcgccaaacccaatccgctactccacacgccgtctaccaccttgtcaacccctgcaagactccctgggcgaccctcgtccccgccgttcaggccaaataccccggtatgcagacggtgccgctagaccagtggctggacgagctggaggcgatcaagtcaccgtcggagaccgaggtgcgcgagaagcccgcgctgaaactgcttgatttctaccgcggactcgcgggcgaggtgctctcggccagtattagtgtggagcagacgcgcgggggcagcaagaccatggagggattgggggctgtgacaggccagttgatggggaattggttggggcagtgggatttctga

SEQ ID NO: 323 - DNA, 327 bp, Aspergillus niger
atgcatctttctacattgctcctccccctcctccccaccgccgccctctccgcaatctgctaccccgagaccggcggctcgaactgcgcctcgctcctcagcatcaaagaattctactcccttcaatactgcacctaccggtggaacgtgctttacggcgactgggaccacttcgtcaacaacgcgaccagcccgacgaaggtgcacgccagcgtgggtaagacgggcgtgtttgatagcttcgaggactgtcttaatgggtttgaggatgtcgtggagacctgtcatggtgttagtcagggtggggttatgaccaatgggaattga

SEQ ID NO: 324 - DNA, 1578 bp, Aspergillus niger
atgcagctctcattgttggctcttcttggagcattggcgctgcccagcgctgctgttccccatgcgcgcgatgagggacaatgcaagcagaccactgttgctattcttggtggaggaatggctggtattgctgctgctcaaacgctgcacaatgcctccatggatgacttcatgatcctcgaataccgcgacaccatcggcggtcgcgcctggcataagcccttcggtcaggacaaagatgggaacccatacatcattgagatgggttgtaactgggtccaaggactcggcactcctgggggtccgcagaaccccgtctggacactggcccaagtctacaacctctccaccatctactccaactacagcaacgtgtcgacctacaaccagcacggctacaaagactactcccacctgatcgacacctgggatgacatctacgacaccgccgccgcccaagccggcgtcatgctcctcgacaacctgcaggaccagacagcccagaccggactggccctcgccggctggcgccccaaggtcgacgacatggaagcacaagccgttgactggtggtcatgggacttcgaagacgcctacacgcccctcgaaagttcctttatcttcggcgtcgcaggccaaaacctcaccgtgaacggcttcagcgacgaagacaactttgtcatcgaccaacgcggctacagccacatcatccacggcatggcgtcgaccttcctcaagcccaacgacactcgcctgctcctcaacaaccacatcaccaacatcagctactccgactccggtgtgaccgtccacagttccgacggctcctgcgtgcgcgcctcctacgccatctgcaccttcagtctgggcgtattgcaacacgacgccgtcaccttcaccccgtccctgcccgaatggaagaaagaagccatcgaaggcttcacaatggccacctacaccaagatcttcctccagttcaacgagaccttctggcccgaagacacccaatacttcctctacgcggacccctacatgcgcggctactaccccgtcttccagtccctcagcaccgagggcttcttcccgggctccaacatcatcttcgtcaccgtgacggagcaattcgcctggcgcgccgaacgccagtccgacgagaagaccaaagcagaggtgatggaagtcctgcgcaagatgttcccggagaaggatatccctgacccgattgcgttcatgtacccgcggtggaccctggagccatgggcttacggcagttactcgaactggccgcccagcacgacgttggagatgcatgagaacctgcgtgccaatgcggggagactgtggtttgccggtgaggcaaccagtccaacctactttgggttcttgcatggagcttggttcgagggccaggctgcggggcttcatcttagcagtatcttgaacggcacttgcaaggcgaatactacttgcaagggcaggaagcattacgagacgttgcacggcacgacgccattgtcggattacagcttcgtggatggatggaacggaaacagtttctatgattttaacgatgattaa

SEQ ID NO: 325 - DNA, 1083 bp, Thielavia terrestris
atggcgcagttcattacgcccggcctcaagcagtcgatcgaaaactccaaatgcgagtaccgtcggctgggaaacagcggcctccgcatttcggtgcccatctttgggtgcatgagcttcggcgaccccaggacgcttgactgggccattggcgaggaggaagcgctcccgctgctgaaggccgcctatgacagaggtctcaacacatgggacacggccaacgcgtattcgaacggcgcgtccgagatcatcgtcggcaaggcgctcaagaaatacaacatcccccgggagaaggttgtgatcatgaccaagtgttacttcgctgtcggggaggagcccgagctgcgcggtttttttgtccgtgaccagctcgcccagtccaaggactacatcaaccagttcggcctgtcacgggccgccatcttcaaccaggtcgaggcgtctctcaagaggctcgacacgccctacatcgacctcctgcagatccatcgcttcgaccggaacacgcccatcgaggagaccatgaaggcgctgcacgatctcgtccagtcgggcaaggtgcgctacatcggcgccagcagcatgtgggcgaccgagttcgcgcgcatgcagttctgcgccgagcgcaacggctggaccaagttcatcagcatgcagaaccactacaacctcctctaccgcgaggaggagcgcgagatgaaccgcttctgcaacgacaccggcgtggggctgatcccgtgggcgccgctctgcaggggacacctggctcgccggccggagcagttcggcacgacacctcgcagtcagggagagaagcagaaccagcctggctcgcacggcacggtcgagccagacctgaccatcatcaagcgggtcgtggagctcgcggacaagcatgagtggccgatttcccatgttgctctggcttggatcaataagcgggtcacaagtcccatcattggcttcagcagcgttcagaggttggaagaagcgattgcggcgagggggaaggtactgaccgaagaagaagagaagtacctcgaggagctctatcaacctaagccgatccaaggacattcgtag

SEQ ID NO: 326 - DNA, 3378 bp, Thielavia terrestris
atgcagctcacactgccttggtgcttaagactcatgcgggtgcagcgcatcttttcctattcgacatggctggacaaggtgcttctgcttgtagccgtcttgacctccatcggggctggtgttaccatgcctgtcatgaatatgatctccggtcgcatggttggctcattcaccggatacttcagcacagatgccgccacgacgtatgagatgtttgagaacgccatccggacctgcgccttataccttgtcggcttgttcttcatcaggcttgctttggactacgtggcatatgcttcgaccacggccaacgagatcttcagctccgtcaggataattgccgcgtgcggagcggacgaaaggatggcccggaggtatgcgacttgggtcgatgaatcccgccgccggggcttgaagatgtctccgctcattgcgctgcagcaggcgccagtccagtttgcagtctacagggttctcatgtcggtcatgctgatgacgacgtcgatcggcggcatcacgggtcctctgtcggccgctgctcgagctgcgggtgcggcgacagtcttctataccatcattgatgccccgaagccagacaagtctggggtccaacatcctgaagtatccgctgcggaggacatcgtgctcgatcacgtcaattttgcgtatcccacaaggccggatctcaggattctcgatgatttaagcctcaggtttccgtctggcaaagtcactgccattgttgggccatccggctcggggaaaagcacaattgttggtctcctagagcgatggtatgagatcgaggctcctgacagtaaccacccggtacgtctggcctggcgcaacggctccatcacgattggtggccgaccgttgagagaggttgatctgaagtggtggaggaggcagatcggccttgttcagcaggagccattcctcttcaacaacaccatctacgcaaatgtcgagttcgggctcatcggcacagaatgggaagacgctgaagtgaagacaaagaagcagcttgtaaaacaggcttgcgtggaagcttttgcagatgagttcatcagccgcctgccggatggatattccaccgtgataggggacgccgggatcaagctcagcggtggccaacgccagcgcttagccatcgcgaggagcatcgtcaagcgcccgaaaatcctgatccttgacgaagccacgagcagcatcgacgtccgtggcgagcaaatggtacaagcggcactggacagggtttccaagaatcgcacaacgctggtgattgcgcatcgcctaaccactatcaggaaagcggacaacattgttgttctccgcaagggcagggtcgtccagcaggggacgcacgagagcctgatgaaggaggaagggggtgtctactggaccttggctaccgctcagcagctcactctgggagccgaagaacagcttgacgacatggtgcagaatcgcgacgcgggaataagcgagaagacgagcatggccaccatcgccacaggcaccacgcttgtagagagcacggccgcgttggacggcgatttcgttgaccggacgaaagtccgcggattttggggcagttttggcttgctgctccgtgagcagaagcaccggacgaagtggtattccatactgctcctcagcgccttgggcggtggagccagccagccgatccaggcgtacctgttcgccaccgagctcactctttttcagttctggggcccttggctccaggccctggcaaacttctggagtctgatgttcgtcatgttagccctcttcgtggcgatcagttatttcgccctgggttggtcttcatccaccctcgcttttcatatcacccactactaccgtggcgagtacttccgaaacattctctccaaatctgtggccttcttcgatgcggacgaccactctgtcggtgccctcacagctcggttggccacggatcccagcctgctccaggagctgctgggcacgaacctggccttcgtgattatctcattcttgaatgtcgtcgggtgtttggccattgccttctactttgggtggaagctctccatcatcactctctgttcgtccatgcctgtcatcttcgcagcggcattcttccggatacgatatgagacacagtttgagaagatgaacaacaaggtcttcgccgagagcgccaagtttgccacggaatcgattggcgccttccggaccgtctcggcgctgacgctcgaggacaccattatccgccgctacgagaccctcctccaaacgcatatcagacaggctctctggaagtcgagctggacgacgctgatctttgccgtggcggacagtgttgccctactttgcatggcatttgtgctttggtacgggggaaacctaatgcttaacagagagtattcatcgttccagtacatcgtggtctatattgccgcccttcagggaggcctgggtgccgggcagtggttgagccatgggccaaacatcgcgaaagcatcggtggcagccggccgaatcatcaacatgaggaaccaggatcaggtcgatgggaagctcgtttctctggacgttggggacatcggagatgacgatatgggggtgaagatccagttccagaatgtctggttccgataccctacccgagatgttcccatcctcaatggtctcagcctgacgatcgagaagggccagttcgcagcaattgttggcccatcaggatccgggaagaccactatcatatctctactggagaggcaggtaacaacaggaaatcgcgacttattctactcgccgaatgcgggccgcatcctgtacaacgggtccgacatctccgatctttgcttgaggacctaccgcaaagatatctcgctggtagcccaggaaccgaatctgttcgatgggacgctccgggaaaacattctcctcggagtggacgaggagacaaccaccgaagagcaactccaccaagcatgtcgcgatgccgagatccacgacttcatcgcttctcttccggacggctacaataccgaagtgggcacgaggggcgtcacgctgtcgggcggacagaaacagcggcttgccatcgcacgagcactgattcgaaacccgcggctgctgctcttggacgaggccacgtcaaacctggacgccgagacggagaagtcggtgcaggcggtcttcgagaagaacaagaagaaccggacaatggtggtcgtggctcaccgtttggccacgattcagaacgcggatgtgatcttcgtcctggccgacggccgagtggtggaaaagggggaccatgcctcactcctgagtaggcgagggatgtactatcagatgtgtcaatcacaagccttagatagatag

SEQ ID NO: 327 - DNA, 765 bp, Thielavia terrestris
atgaggtttctatgtcttccgggagcctatggcagctccgataagtttcaagtgcagttggcaccttttgtcaaggaactgactgaagatgggactgctaccttccacttcatccatgggccctgcaaggcagtcccgccggaggggtttgaggagtactttggcaagccgccgtatttccgcttcatcgagccggacaacgacctggagaaaagcaaggaagacgacattctcgcgagaattcgagactttccgcaatgtgagacgcccgaggacaccatgcgggagctgatgcgagagggcatcgcgacgacgcaccggagcaccaacaacgcgctcaagtacttgctcaagatcatgcaggagcgcggcccgttcgacggcatcatcggctattcggagggcgcgacggtggctgccacgcttcttctccacgaacagagaaggttcaggaagaaggggatcaagcccatgttcaagtatgccatcttcttcgccggatggccgccagtcgacccggacagccacaaaataattctgagcgacgagtctgacgccatgatcgagattccgacctgccacatcattggctccctcgacccctatgtgcacgggtctttggcgctctacaatgtttgcgacccggataccgcgtacatgtttgatcatgcgaagggtcacaccttgcctcgagacaaggacactgtcaaggagcttggggatgtggttcgagaggccatcaaaacctatggtattcattcctga

SEQ ID NO: 328 - DNA, 6738 bp, Thielavia terrestris
atggcgcccattgccatcactccggacaacagctccaccggcagcccgtcaggggagagcgtcaacggctacttccatgtcagcaccgacaaccgccaggccaatgggcataccaacgggcacaccaatggctacgccagcagacacctagatggacacccgaacgggcattcaaacggagccggtaatggtgttttcaatggcgtcaatggcgtcaacggcgtccacgggccctcgggaggtttctctacttcccataagccgatgcccatcgccattgtgggaatggcttgtcgcatgccgggcaatgtctctactcctgccgagttctgggagctctgcacacgggctcgctcggggtggaccgagatccccaaggaacgattcgacagctcccggttttaccacccaaaccccggcaaggggggcgccctgaatccagtcggcgggaacttcctcaatgttgatctcgccgccttcgacgcccctttcttcgggctcacagagaaggaagccatatctatggatccccagcagcgccttctcctggagtgtacgttcgaggccctcgagaacgcgggaatccccaagcacaccatcgtcgggaaggacgtcggcgttttcatcggcggctcgttctccgagtacgagtcacacctgttccgggattccgatacgattcccatgcatcaggcaaccggctgcgcatttgcgatgcagtccaaccgtatctcgcatttctttgacctgagaggcccgagtttcacgtccgacacagcctgttcgtccagcatggtcgctgtgcatctggcttgccagagtctgcgggccggcgagattagctgtgccctggtcggcgcctgccatctcaacatgctaccggagttttggatctccttttcgacttgcaggtacgtccccgttccagagcccggcacatccgcaatcagggacaatgacaccatcagggcagtcattgtgggaaccggcttgaaccaggacggaaagacgcccggcatcaccatgccaaacggagccgcccaagaggccctgatgagacaggtgtacaagaacgcgggaatcgacccacgcgactgcggcttcgttgaagctcacggaacgggtacccgggtgggggatcccatcgaggccaccgccatccacaacgtgctgggccagaacaggacagcacgcgatcccctgtggatagggtctgtcaagtccaacattggccatctcgaaggcgcttcagggattgctggcatcataaaagctgccctgatgctcgagcgcggtttcatcctccccaactacgacttcaagcaaccaaaccccaagattccttggaaggagtggaatctcaaggtcccgattgcccagcggccatggccgcgcggtaagaaatacatcagcgtcaataactttgggtttggcgggacaaacggtcacgtcgtgctcgaggctccgccattccgaggaccaaagggttctgccgccggcggtgacgacacatctggaaaggcaggacaaggacggaagctctacgtcttcacggccaacgacaagacggcgctctcgcaggtgatgaagaacatcgtcatttatcttgaacagcgcccagaaatcttccaaaaggacctgacaggacatctagcctacaccttggggcagcgccgatctctcctgcagtggagagcggccattccggccgtcaattctttcgagctcattgaagcgattaacggcgaaaagtacactcccggaaaggagactgggccgctaaggatcggcttcattctcaccgggcagggcgcgcagtggcatgccatgggacgagagctctatgagcagtatcccaccttcagcagcagcctcgagctggccgacaggtgtctggctgagaacggtgctgactggtccctgatcgaggaactgggaagagacgcaaaaaccagcaagattaacgaggcccatatcagtcaaccgtcgtgtactgccatccaactggcgctgattgacttgctgcggtcctggggcattcgtccaaccgccgttgctggtcattcaagcggcgaaatcgcggccgcctacgccgcggagatcatcgacttcgactccgccatgcggattgcgtaccatcgcggcaggcttattcccatcctcaaacgatctcatccggagctcagaggccgcatgatggccgttggcggcagcaaagagcagttcctgcccattctcgacggcctcaaggagaaggaagcccgcatcgcctgctacaacagcccctcgagcctgaccatctcgggcgatgagccggccattgccgagctcgagaagatctgcgaggagaagcagctctttaacaggcgtctcgtggtggacgtggcataccattcccaccacatgaacctggtggcgaaggagtaccgagcgtcgctggccgacctgcggccccccgttcccaccgacatccggttccactcatccctttacgggcgcctggtcgacggtacggagctgcagccggactactgggtggagaacctgacctgcgcagtgcgcttttcggaagcgttgcagagcatgctggaacccgccggcgagcacaagcacggcgtcaacatgctcgtcgagcttggtccgcattccgggctccaggggccgatcaagcaaatcctgaaggagatcggcggcagcgcccttaagatcccgtacgcgtccgctctcgtacggaagcgtgatgcggtagagacggcgctggaactcgctgcggatctgttcaccaggggcgccagcctcaacttcggggcaatcaacttccccaagccgaccaagccgcccgtgctgctgaccgacctgccgcggtacccctggaattactcgtccaggtattggcaggagtctcgcatgacaagagcacacaagcacgctcctggcggccggagcgacattctaggcaccctggccaactactccaacgacttggagcccacctggcgcaacattgtccggctggatgacctcccctggctgcggcagcacaagatccagtccttgactgtctttcccatggccgggttcattgccatggccctcgaggcagcggctcaaagagcatccgcgaggggctgcccgttcgacagtttcgagctgaaggacgtctcgattaccaagcctctcgtcattccagacaaggacatcgaggtcacgctcaccctcagaccacgaaaggagagcggtccctcctcccctggcagttgggacgagttccgcatctgctcctggtcgagcgaacagggctggaccgagcactgcgttggtctcattgcggctctggaagcggatgtcaacgaggtcgacagtgccaggcgcgctcgagacgcggaggctcgtctcaagaccatcctgtctcggactagccagccggaagcggtgcctgtgactccacaagccatgtatgacagcctctcgaagctgggcgtggcctacggggctcttttccagggagtaaccagctgctacgcatccgactcccacgcggtggggaaccttgtggtgccagacgtcgcaaaggagatgcccagcggttatctaaccgatgcggttctccagccggcgttcctcgagtctctcattgagatgtattggcccattgtcggagctggtcgacgtcccgtcggcaccatctatctgccctcgtctgtcgaccgggttactgtctctctcggcgtccagcggtttaccaaggaccctggcagcgcggtccgcgccgtttgcgaaggcgagatcgccgctggttcgagccccaagccagccaaggtcaacgtggccgccgtcacgggcgacgacaagcttgagacgctcatctccctggatggtctcaccatttcccccatcctcgacggcgagacgcaggcggactccgccgcagcgagggaactctgctataagttggagtgggatccgatcctcgagaccgacgacgagagcgtccaagaccttccaacggacgcccaggtcgtcatcatccacgaggactccagtttccaaagtctcgtggcaatgggcctggcaaactctctggagcaggccactgggaggctggctgactttggcactctggaaaccgtcgacgctgccggcaagatctgcgtctttctgagcgagctgcaccagccgttccttgcgacactcacacccgcccagttcgacggcctgcagaggctgttgacgtccgtcgagggcgtactgtgggtcgtgcgcggagcgtacgacaactcggcaaacccagatgccaacatggtgaccggcttgagccgaaccatccgatcagagactgcgctgaagtttgctaccctcgatctggacgccgagtcaccgctctcggagcttgagacggccgacgcgatcatgaaggtcttcaagttcgtctttcactcgggttcctccatgtctggagaactggagttcatggagagaggcgggcgtttctacacgcctcgaattgttcacgatcccgagatggacgagtacgtccacaagcagacaaacccatccgctctcgagcctacgctgtttggggaggaccaccgagctttgaagatggcactgtcagcgccgggcgcgttggagacgctccacttcgttgacgacccggctgctgagcagccgctggaggccgacgaggttgagattgaggttaaggccatcggactgaacttccgggacggtatggctgccaaaggccaaatccctctgggcagttgcggaatcgaagcaagcggagtcgtcaccgcggtgggaagcaaagtcacggcctaccgggctggcgatcgtgtcgcggcgcttaccacaggtgcgtttgcgacgcgaacgaggacaaaggcggccttcgccttcaagatctcggcggacctcacattcgaggctgctgccagcctgccgctcgcgtatgcgacagcatactacagcttggtagagcttgggcggctcggtgaaggcgagactgtcctcatccactccgcggccggcgctgttggacaagcagccgtctgcatcgcacaaatgatcggtgctgaggtctttgtgactgttggaagtgcggagaagaaagagctcctgttgaaggagttcggactcccggacgagcgtgtcttctacagccgcaacagctcctttgcagacgcaatttgccgagatacgcaggggcatggcgtcgacgtcatcctcaacaccctcaccggggacgggctccgcgagtcttggagatgtctgaacaagttcgggcgcttcattgagcttggccggggagagaatgtctctaaggcgcggctggaagtcgacagaatcgacagcaacgccagcttcatctgccttgacatgctggccctgatctctgagcggccaaagaccatcaagcggctacttgcggacgttgcgcagctcttgaagtacggcaagatcaggcccgcagttcccatcacaagattccccatctcggacgtcgaaacggcgttgaagacgcagcaaactgggaagtcaatgggcaagctcgtggtggttcccagtgcgactgacgtcgtcaaggctgtacaggctgctcgttctaggaaggcgaagcccctcctccgctcggatgccacctatatcctggtcggcggcactggtggcctcggccgcagttttgctaggtggatggcggcgaagggagcaaggaacatcgtgctggtctcgagaagcggctccgtaacgggcagggtaaaggagctcgtcgacgaacttggcgcaattggcaccaacgtcgttgttcgccgctgcaacgttgtcaacaagagcgaagtggacgagcttattagctccatcctcggcgacctgccccctatccgcggtgtggtgcatggcaccatggtactcagggatgtgcttttcgaaaagatggcgtgggaggattacacgcaggtcatcgagggcaaggtgcaaggcggatggaacttccaccacgcactcgcagactcgccgctcgacttcttcgtggctatctcctcggccgcaggcgccgtcggcaaccgcgggcaggccgcctacagcgcggcgaactgcttcctcaacgcgctggtgcagcaccgtctcgcccgcggcctgcccgcggcctcgctcgacctgaccgccgtttccgactcgggctacctggccgaggacctcgagaaggcggccgaggtggcgaggaacctcggcagcgacagtatctgcgagagcgaggtgctcgcgctgctccaggccgccatcgacggcacgatggcctcgacctgcaacagccacgccatcaccggcatgcgcatcaccgcgaccatgcggccgttctggaccgaggatgccaagttcaaggcgatgcgcatcgcggccgaggaggcggcggccaaggacgcttcgctcaacgccgtggtgtccttcaatgctgccctcaagcaggcaaccacgcgcgccgaggcggaggatgtcatctgccgcggcctggtcgacaagatctcctcggtcctgatgatggaagccgaggagttggacatcaccaggtcgctgtcccattacccgctggattcgctggtggcgattgagatccgcaactttatcacgcgcgagttcgaggcgaatctgcaggttttggagctgctgtcgagcgggtcgatccagacgcttgcgaagggggtctgcgcgaagagcaagcttgttactttctcttag

SEQ ID NO: 329 - DNA, 1794 bp, Thielavia terrestris
atgcccgagaagtgagcctcagctcagccagtgctgaggctggaagacgctgggggacgcttggaggactgcgcagcgcgcgagaccgcaggatcggtcaggagggcaaaacaacaatactccctgtcgccggtcggcagaggcaccatggagtctgctctcaacgggaagacgccgagcgcacaagtcgtcgggacgacttcgctgtacgagaatggccaaatacggttgattcccgcgccaagtccagatccgaaagatcccttgaacttaccggagtggcggagatgggcggccatcgccagcctgtgtttctccctctcggcggagatcattgttggcagccttatcccagtgttcctcctctattactccggggtcgatgtgcgcatcctcaacgcatttgacttccgggccgtcagcggcgggtctgcgacgggcgtcaaacctcttgccatcatcccacagggcgtcgtgcctgccgacattgggaaggtctccatgctggcgaccattccgctgctgagcaacggcattgccagctacttcctcgtgcccttgtccattggcatcggacggcggccggttctgcttttcgccggcgcctgcgcttgggctggtggtttcctcgctgtcgcaagcccttctctagatgtccacttggctgcgcgagcgatacaggcgagtgtcttgagcacagagctgcctccgcctgacatggtcttcattcaccagcgaaacaaagccatggccgccgtggttgcgagtcaagggatcctcattacgggtttgggaatcctcacgccgtacctcgcctcagttcacgactggagatggatttactatatcacctctggtttcgggatcgtcgcatggcttttgttagtcgtgtttctcccggagacacggtggacgcggtcgaaagaagagctaagcggtcagcagttctatcccatcgaaccagggaagaatcggccggaaatcgactatggaggccgtcctcccccatcacagtggtcgtacatggcattgttccagcacgggtttgagtggagacaggcgggcatgtccatgctcaataccctcaggaccactccgttccctgccattgtctgggctaccctggccaacagcattttcgtcattgtcaactcggcggcgcaacagattagctcctttgccctcctagcacagggttggcagttccagtataccggtctgagtgtgatgccattcatagccgccaccggcctagtttacatattcggcggcccagtcgccgatcgaatctcgaatgccatcgcgagacgcaacggcggtgcccgggagcccgaacaccacctgctcaacatggtcttgcccctcgtgtccggcctggccgggaccttcatattcggctgggcgggccagaccaacgcctactgggccgtcttgatggtgggatccttcctcattatcttcggctctctggtcgtaatgtcggtcctcaacgtttttgtggtcgagagttaccctatgtgggccggtcccgtgctggtcaacgtgtcgagcctacgcatcatcattgccttcttcctatcgagtcagtccacgacgtggatcgccgagaagggcttcttgaacaccttcgttatctattccgaggtcatgatcgtcatctccttgggcataccggttctgtatttctttgggaggaagatgaggcaatggaccgccggcaaagtgaaaacgacggctcccagtgacgtcttgaagaaggagtttgatgacagcttgagtgagaggtcggcttga

SEQ ID NO: 330 - DNA, 870 bp, Trichoderma virens
atgaagatcctctgccttcacggtagaggctccaacaacgagatctttcgggcgcagacggcagccttccgtgcagatctcgatgactttgagtggacctttgtgcaaggcacggttcgacataccgaaggcaactggtccctgtacacagcacaattctcgcatcttccactttacacatactacaacccttttgatcctgcttctatcttgcagactcatgacgaccttgcgcggattatagtcgaagagggcccattcgatggtattctgggctattcaggcggtgctgcgttagcagcagagatcttggctcaggcaacctatgatgatccctttgccatggaacgaccgtttcgatttgcagtcttcatcaacggagcatctcccctgcgctgttttgctatgaaggacgcccaagtcatcgaggacatcgtcgtagattccgcacccatgaccgagcaggcagagaatatgtttcttcgtccgagtgcgctgcgaaagaaggacggagtcagcgaacaggaccaggtcgaccatgcaaaactactgtcgttgctcaagaaactcaagggcaagaagttggtcgatggaacaacgtttctatccaacggaacgcatggcctttgtagatgggaactacccgcagacggtgcgccactgattgacttgcccacgctgcacatccggagcaccgagagcgacgagagtgatccccacgagggtctccatttgctacgactctgtgatcccggccaagcacgcgagttccatcatggcagtgggcatgatttccccagaggtcgtaaggaaatgaagcacattgcgagactgattcgagaggtcgctgaagctacaacaagtctataa

SEQ ID NO: 331 - DNA, 1584 bp, Trichoderma virens
atggctaccatgagcgacgtctgggttggcctgccatggccagtacaattgatcgcgacctgctttgtcctcactgcaactctgttgatcacgactcgcctcaattcactctcccattcatggccagcggcagcaggaaaaggccacgaacctccaatagcgccctactggcttccaggaatccagcatctggcagccttccttctcgatcctgcccacactttccgcacgacccagtcgaaatacaaagattcgccttacacattgctcatggggaacgtgaagttccacgtttttggttctccatctgccgcgacccatgtctttgcacgctcgcgcacgtttgcgtatgaaccggtgaccttgagcatgctggagaatggactggatctgcccgtggccgaccgagtttactttcaaatcggtctggatcgagcaaatagtgcagagcatgcgaaggggttcgtggtgcaaaaccataatgtctggttgcgatacttgtcaggcgagccgttggacgacctgatgcagctattcacacgccacttccaccaaatcctggagcaacacctggatatgaagacaagaggctggcagacagtcgatctataccaagtcctgcgcaaagtcattttcgacacctctgtcctgacgttcttcggtccccatcttgctcagatatggggtcctaccatgtggaaggacttctgcctgttcaacgatgccacctatattggtgtcagaacaaatttggcgtatgtcttgcagccgcgcgctggccgcgcgcgggagagaatgctacgcgcctttgaacagtggttaacgcaccattcagagggagactggccggacaaggacaaatattggaacgaggaatggggcgcaaaaatgaattgggaacgtgaccatctggcgcgacaattcggcctctccctccgtggacgggcggccatgcaggcgagcttcctgtttgcaatcgttctgaacgccgcgccgatgagttcctggtttacctgggtggcggcgagtaattcagatcgcctggcaaagtgtcgagtcgagtcgtccaagttcttgcgaccgagcaaatcaagccgcttcgatcacgaattggacatcgacgccacgcaaatgagaggcagcaacttcatgcaggcgttgtggaaggaagcgttacgcataggcacggcagcctcgccagcacgtgtagtcatggaagacacagagctggaagggtatgtcgtaaggaagggcagtgtgatcctcatgcccactgcgttgctccaccatagcgacttgttcccgagagcggaccaggttgacacggaaaggtggacaggcgaggatgccatagtccaacagcggagtaaaagtattcgcacatttggtggaggtatgggcatgtgttctggacggcatgcggccgagcaggaggtcatcggtctggtctcgaagcttattacgctgtttgatatcgagttcgaagactcgtggaagaacaagttccacttcgacccaagaagtctcggaattatgcatcctgcaggtcctctaatggtacgcctgaagcggagagtattatga

SEQ ID NO: 332 - DNA, 7917 bp, Trichoderma virens
atgtcgaatcatggacctgacgaggccatcgccatcgttggcattgcttgcaagcttccacaagaagcctcgaccgtcgaacgcttttggcaattcctcctgcaaggacgaagcgcacattcaccatggccagatgatcgcttcggagccggccactatcatcccgacaatgagcgagtcggaacacactcggtcaaaggggcgcatttcttggccgagccgcccgaatatttcgatgcaccctttttcggcatcaccaaaggcgaagccatttgcatggaccctcagcaacgtctggtgttggagaacgtctaccatgctctagagaatgcaggaatcccactctccgaagccaatggatccaacacgtccgtgtatgtgtcgggcttcaatcacgactatctctccatcataaatgcggatgcggagagccctttgcgatatcgtgcaaccggattgaccaactccgtcctcagcaaccgagtctcttggtttttcgatttcaaaggtccaagcatgaccatcgatactgcctgtagcagctccgtagtgacacttcatcaggcgtgccagagtctacgtagtggcgagagcgacatggccatatccagcggggtcacggtcttggcttaccccaacgatgtggcctccatgtcttatcaaggattcctatcgcaagacggccggtgctttagcttcgatcaccgtgccaatggctatgctcgtggcgagggagtcgggacgatcattttaaagcgtttcagtgatgccattcgagatggcaactctataagagccgtcattcggggcactggtgtgaatcaggacggccgaactcctggattgaccaacccggatagtctggcgcaggaaaggctgatcaggacggtctatgcaagggcaggcttgagtgtcaacaatacggccatggtcgaggctcacgggactggtaccgcggcgggtgacccgatcgaagccaatggaattgcgagagccttctcagctcggccaaggaatctccctccgctgtacattggggcttgtaagtccggcattggtcatttggagggcgcggcaggcgctgcagccatcatcaagtctgttcttatccttgagaatgggatcatccccccaaacgtcaatttcgaaaaagtcaatccgaagatcccggcaacaaaatggcggcttcaattccctcttgaaccaacgccttggcctacgatcggcttgcgcaggatctctatcaattcctttggagtcggcggtacaaacggccatgttgttctcgatgatgcttttcactatctccaggaccgagggttgaccgcgactcattatacacgacccttgcctccgaccaacgcagatctcgatctcgtaaacggcgatagattcaacatcaccaatggacatgtgaatggtctcaccaacaaccatcccaacagtgctggagatagcaatgcccttgccggagactggagggctttcgatccaatcgagtgtccaccaaagctcgttcccttttctgctttcgatgaagaaggctgcagtcgcgcagcaaaaacacatgcagaattcctccatgccaggcccgaatcgatatccgactccgaaagtttgacctatctgaacgatcttgcccatacaatgagtcggcgctcgaagctggcctggcggagtcacgtattagcaaggtcgctggtcgagctcgagacacgtctggcttcgcccttgcccaaaccgctgcgggctcgcaccactgtcaacgtggcctttgtgttcacgggtcagggagcacagtggtatggcatgggacgtgagctactctgctacccggtgttccgtgagagtctggctgcgtgcagagtttatttgcagatcgaatgtggctgcccctgggatctcctcgacgagctcgccaaagacaaagaacatagtcgtcttgatcaagcagccttggctcagccggcgtgcactgcccttcaagttgcgattgtggatttgttgcaatcgtggaatatccagcccagtcgtgtcgtgggccattcctccggcgagattgctgctgcttactgcgctggccttctgactcgcgagtcggcctggcgagcgtcttatttccgtggactagtcaccgggaggcagacgaccgagaccaaaggcgctatgcttgctgtcgggttgggtcaagaagcgctcgccccttatcttgaccgaattcatgcccaactctctggggaattagttgtggcatgtctcaacagtcctcgcagcagcaccgtctcgggtgatgtgcataaagtcgaagctctgcaacaagtcttggaggctgaagggctcttcgcgaggaagctcaaggtcccaaatgcctatcactctgcgcatatgcaggaattcgcagacgaatacgtccgtctggtgggtacgctccacgcgccgagcgagccacctcagtcacctgtggtcatgatctcgagcgtcacgggggaagcagtcgaaggccgttgtctctccatcgactattgggccaagaatctcctaaatccagtgcgtttctccgatgccctggcaggcctttgctttagccgcacaacccaaacacaggccaccctccgtgcagatgctgctggagccaacgtctttgcggatgttttgattgagcttggccctcatggagcattgcaaggcgccataagagatgtgctcgcagctcatgccgagggcgttgcggtagcattcctcccggcactgaaacgcaatgcccctggggcagacgtattcctgaacgccataggctaccttcatgcccgcgggtatccgatcaacgttgatgacgtgaataacagcgctgatacgactggtggaagagggtctcgcccattgcgtatacttcctgaacttcctggataccagttcaaccattccaacaagttttggtatgagagtcgcttaagccggaactatcgcctccgcaaagagatcagacatgacctgttcggtgctccagtacccgactgggacgcgatggctcctcgattccgcaactttctgagaatctctgagcagccatggctacgagatcacatcgttactgataacatcatcttgcctggcgtaggctacgtgattgcggtaatcgaagcagccagacagctggctgatccaaatgtacaattgagcggcttccggcttcgagatgtcaacatgaaacgtgcattgatcgtgcccgacacgaaagaaggggtcgaagtaatgttgaatttcaagccagttgatgagtccagtgtcggcacttcggcttattggcgtcggtttcaagtagtgtcctataacccaaccgcgaacgactggatcgaacactgcactggatacgttggcgtggatcatgagacatctgcccccaatccggtcgaccagggacgagaagcccgacacgacgcagaacgctggcacgccgctttcactgctgcagaagagcagtgtcaatctccctgggacttttccaaggcctatgagcgattggcaagaatcgggctgaactttggaccgctgttccagaactgctcggctgtccggggtacctttgaccatggtggccagactatgggcacagtcaccgtccccgacgttgcaagtgttatgcccaagggtatcgtatctccgcacttgatgcatccagcttgcatggacagcttgatgcactttgcgctggccgcgatcatggacgccacaggaaagagcaacctcgaagtggccatggtgccgcggttcatcaaggacatttggatttctgcggcaatgaaccctgagcctggtcatgtctatcgtgctcacagccagacgcgcaagattgcgtttgagaagttctcgacagatgttgtcgtctgggatggacccactcaagaaccccgtatctcctggagtggaattgaagcaagccccctggattccgccgcacagagctcgctcggcgcagaaaagatgtgtcacgagattgaatggattcctcacgtggatatgtatctcgaaggaggcgacgtcgcttcgttcgctgagatgcccaagcctgatttggactcagagcaagctgcgatcgagatcgattctcgtatgcagctggcctcggtgcttcttgtcctggacgcactggaggaactagatggcaaggtgccggccgctgctcaaggtcatctctatcggtatttcgagtggatgaagcacgtcgagagtgatctccagctcggcaaggtgatcggtatccaagcctctgaggttgagcgactcaaacatgaccacgctgcaaaggtggagctatacaaacaggttgcttcggacactgcgttcggtgagttggcagtacgaatgggcggcaacatcgtgcccgtcttaagaggtgagacagacccgctgcagctcatgttcgctgaggatgccatactcgatcgagtctacagacgaactgcgaccttgaacgacctgccagcgcaacagaaggcctatttgaacgtattagccaagaataaggccaatttacgcgtgctcgaggtgggtgccggcactggctcgtccactgcgcaagtacttgatgcccttgctcccatcgcagatgatggggtgtccattgctagtagcgtgtcacattacatgtacactgatatttcggccgcctttttcgaacaagcaaggcagaaattccagccatacacgaacatcatggagtatcgagttctggacgcagaacaagacatcgccaagcaggagagcttcgaagtcaggagctatgatttgattgtagctcagaatgtcatccataccaccaccgacctcaccaaaacactgagtaatcttcgccagttgctgaagcccggaggccgcctgcttctacaagaaggtataaggcaggattactactggtccgggctatcatttggccagctgtcagggtggtggagtggcaccgaatccatgcgtcaatggatgccatgggtctcatccaagcagtggaatgaagtcctcgaggctgctggttttacaggagcgcgcttcgaacttcccgatagccacaatgaacagctccatagccagagtcttttcgtggcccagaacgcttctgtagacgccaacgagcccggtcccatgtggaagaacgttgtgctcgtcacactccctagcttcgagcgaagcaacactcaaagcttgttgcaagacatcaaagacaagttgaacgagaatctccggttccagaacatcaggatcgtatccctgctagaattggaagggatcgagtatagccaaagtctctgcattgttctagcagaactcgaacgtcctgtgattgcagatctgtcccaggccgagtacgagggtgtccgcaaaatgctgatcgagactaaaagcatcttgtgggtaactggagatgagcttttctgcccccagtacggagccataaccggcctgatgcgtacaaacagatgggaacgtgacttggacgattccaacctggtcacactgaaaatctctgagcctcgacctgaaaatacctcgctgagtgcgtcgattcgaaggctgtgtgaggcgcagttctcgctcactctcccagttgagaacatgaatggcgagttcatgcttcaagatggccggatctggacgagtcggctccgcgaggccattcgtgcagatgaatacttgcaaacagctctataccgctcagaagcagtcccaacgctggccagggatgctggcaggcccatcaagctcacgacaactgttccaggcctgctagaaaaacttgagtgggtgaccgacgagacgtacaatgagccactctccgatacagaagtagaaatcgagatacgagctgttggcctcaactttcgcgatctcatgattgccatgggggagcatacggcgtactcgatgggcagtgaagcagctggcatcatctctcgcgtgggctccaaagtagtcgacttcgctcctggcgacagggttgtctacatctgtggcctagaccatgtcgggtgcatgcacacctatggtcgtttggatcaatcgacagtcgccaaggtccccgatgggctcagtttggagatggctgccggcttgcctgttgtctatgcgacagtcatttacagcctacgggagacggctcggttgatgcccgacgaaaccattcttatccatgctgctgccggtggggtgggccaggctgcgattcgttacgctcaacatattggcgccgaggtgtatgtaaccgtatcgactacgttgaagcgagacttgataattagggagttcgggattccagacgatcacatcttttcaagccgcgacctcacattcgtcccgggcgtgttgcgtatgacaaaaggcagaggtgttgacgtagtcttgaattcgctctctggtgaggcgctgcgccgctcatgggatctggtggcacccttcggtcgtttcattgagattgggaagaaagacgccatgatgaatggcaaagtggatcttcggccctacttgcgcaacgtgaccatggcgagcgtcgacctcgtttctatgatgaagaacaaaccgtttctcatcaagatgctgacagaggaaacgatgcggctgtggaaagagggtgtggcactgcctgcatcaccaactacgataatgcccatgtcgcaggtggtggatgcacttcgcattctccaggccggcacgggaatgggcaagattgttctggtgcctcgggaggatgacgttctgccactccttccaccgtcaccggcgccgcttggcttttgtcgagatgcatcctacgtgctcagtggtggccttggaggtattggacggagcgttgctgcatggatggctttgcgaggcgctcgaaatttgatcttcctgtccagcagcggccgcatcactccagccgtcacaacgatgcgcgagactctcgaagcagacggatgtcgtgtgcatatcttcacatgcgatgtcagcgacaaggaacagctacgtctcgttctcgaacaatgcaagaccctcccacctataagaggagtcgtccaagcagcaatgaagctaaaggacatcatgctcgagaacatgtcgcacgaggaattccagctggctatcagacccaagattcaaggttcgtggaacctacacgaacttctgccccaggatctggagcatttcatcatgctgtcttcagccacgggcgtcctcggcaaccgggctcaggccaactacgccgcaggaaacaccttccaggacgcgctggcgtacttccgtcggcagcaaggtctagcggccacgacgatcgacgttggcgcagtgctagacgtcggatacgtggccgatcacgcggaccgcctcgccatgacaaaatacctaggcagtatgatgaaagtgctgcgcgaagaagagttgcttacgcttatcgagtacggcatgaacgctgctctgcagtcgcctgcacagcttgttacgggcttgactccgttagacaagcatcgtgctcgaggcgtgccgatgctcagttacatgaacttccctctcttcacgcagctgcggcggctcaatacgcagcaagacggcgcagggacgaccgggggtgatggacctgacgttgaagcgcggcttcgagcagctcggactctggatgaggcggctcagattgtgacggaatcggtcattgataagttgtcttccttgctctcaattgcggtcgaggatgtggatccggcgcggaccatcagtgccaatggcgttgactcgcttgttgcgctagaactgaggacgttcatggcgagaaaggtcaaggcggatgtgcctgtgttggaaatcatgggctcgttgagtcttgctcagctgtgtaggaaggtggcatcgacgagcaaagcggtcgagttgctaatagcaggaggcaactaa

SEQ ID NO: 333 - DNA, 867 bp, Trichoderma virens
atgtcccacaacggcgagcccgacccgctctaccgcgagccctatccccttaaccgcgacttgctcgcctccgcccgcctgcacctccagcacgccgtcttcgtcaacggtctaggctacctgctgcacccggccgtccctatcgggcccgcctcgcacgtggctgacatcgccaccggcaccggcatcttcgccctcgccctcgccgcggcccaccccgaagcccgcgtcgaagcctccgacatctccctcgcccaggtccccgcccagcactggtggcccgccaatgtgacctttgcggtcctcgacatcttccaggaccccttgccggcctcactgctcgcgcgctacgacgtcctctgcctccgccacttcgtctccctgcagcccggcgatccgcgcccgctgatcgcccgcttgctggccatgctgcggcccgggggctatctgcactggcaggaatgggacctgaccaccgccgccgtcttcgccccagacggcacctccacccctaagatgcaggcgctgatcgattacatcaaacatccctcccgacacaccgcccaggccacctgggttggcgacttgcatcagagggtcgccgccggcgaggtgcctggcgtggagctggtcgctcacgaccgtgtccgcgccgctaaggccgccgtcgtcgctatgcagcaggaactcatggcgctgggcaccaaggaggtagtcgccagtctgcgggcccgcgagggcgaagcgagcgtcgaggccgctaagttcgagaagatcgcgcacgacgccgtcgacgagtgtctgagcttggggaggggccctgtgatcgatcaggagatggtgacgtgggtgctgaggaagaagtga

SEQ ID NO: 334 - DNA, 1503 bp, Trichoderma virens
atgctctcttccgaccgcacccaatatactctggcactctggctgacgcccgtcgtcctctatgtcgtgtacgcgtggctcaaagtcatcaccggcgccttctttggccctttgagcaaaattcccggccccaagctctgggccatctcgcgccttcctcgtatgtacatggaatggcagggtgaggaagcagctggagtcgccgcgttgcacaagaagtacggcccggtcgtgcggctggcgcccaacgaagtgtcgtttgctggtggtgctcaggcttggaaagacatttatggctaccgaaagaacgtgggccaagagaagcatccatatcgttcgtcggcgtcgtattggcctccggccaacggagccccgagcatgattcaggccatccgtgacgaagaccaccagcgactgcgcaagagtctggccgtctcgttcagtgagaagtccatgaagctgatggaaccacgcgtcaagggctgggctcggcttctgcagaccaagttggctgagcgcggtgatgctgcggtggatatggtcgagttgtttagatgtgcaactttcgatgccatgggtgacctcgcgctaggggacgacctgcaaatgctgagaaatggccgtctctccgactacgtccatgcagcttttagtggcattcgaaccatcatccgccttcgggtcctctccacgtacaattccttcacccgctggctcgttcaagactgtttcttccaaagcgcattcgtccggaaggccgccatggaaaatcttcgctactccgcggaccgtgtggatcgtcgcctgcaagaaccagaccgagaccctcccgatctctggacaaaacccctgactggtatcgacggcaagatgtccctggacgaatatcactccaccgcacagcttctcatgactgcgggcaccgacacttcggcgataggcttgtccggcacactatattatcttcttaccaaccccgactgcctcgccaaggtcactgacgaggttcgctccgccttctcatctatggacgacgtaacctacgaaaccctcgcccaactgaagtacttggacgccgcgctgcaagaaggcctgagactctacccaccggtgcctaccggcgcacctcgcgtcactccgatgcctggatggtccatcggcggctactggatcccaggtggtgtgaacgtccacgcgccccactatgccacctctcgccttcccgcccacttcaccgctcccgaatctttccacccagagcgctggctgggcgacgagaaattccaaaacgaccggcttgatgccgtccagccgttcaacctcggccctcagaactgcttgggtcaggcttttgccatgaacgagatgcgcctcttcatggccgctgtgttgctccaattcgatctacagttgtgcgaggacccccgagcctggttggatcaacgagtgttctccatgtgggagacgaagccgttgatgtgtgtcgcgaccaagacgagctga

SEQ ID NO: 335 - DNA, 1569 bp, Pseudogymnoascus pannorum
atggaaacaatagccttcttcctcgacaaggttcaagaatggtataagccctacaatcttggcagcaaattatctattccgacggcgcttctggcaatagctgtcttgcggctgctattctactcctctaacccaaagcacaatgcagatatcaaaaatatcccaattgttggtaaagagtatggaacgtgggaacagaggagtcgtgcgtttgccagccggggcaaggaatttttgaatgaaggataccgaaagtacaagggcggagtatttcaagtggcaacaactgaagggcctaatctgtttgtcacaggccggttcatcaacgaactcagaaatcagccagatgagattgttagcttcaacgcaagggcagaagagcgaatgcttccacagtattcactgatttctcagaagaatcttctaggtgtacattctgtcaagggagatttaacgccaaaccttgcacgcttgctgcctcacgtggtagatgaaattgaatcagcagtggctgaggatattggagattgtaaagaatggacatcgctcgaaatatacggtcaggtagcacgggtggtatccaaggcaggattccgtatgttcgttggccccgatttatgccgcaatgaaacatggatcaaactttccatcggctacactgcaactacatttgctggcgctgaggcaataagaaaatggcatccctggctccgacccatagtctaccgatgggtgcctcaactgcaggcggtccgcaaaatgaaagcaaatgcgctcgctctcctcacccccatcatcaatgcgcggaaagctgcaaattaccaagcggacgaagagaagccggaagatatgctccagtggatgtacgacaagtgcagcgatgcggaaaagaatgactatccatatcacctggatcttcaacttgttctcgggctcgccacaatccattcgacgacgatgcttacgacaaatgtgttatatgatctggtaagtagacctgaatatatcgagccccttcgggaagagattcaggagatactagcacaaaatggggggatcttcacgaaacacgccttggaacatctgaagaagatggacagctttatgcgtgaatcccagcgctggaacccgatgaatttctctggatttgttcgcaagatcctagtcccattcacactctccgacggaacatatattccagccggtaccaattttgaagtacctgtgtacgcaatgtccagggaccctcagatctgtcctgggcccaaccccgatatcttcgatggttatcgcttctacaacgcgaggaaccaaagcaaagatgaggcgaatggccatcaactggttactgtcacctcgtatacgatgtggtttggatatggacatcatgcctgtcctggccggttctttgcgagttataagatgaagcttatgctggcaaatatactgctcaactatgatgtcaagtttccggatggagaggtggagaggtacaaaaatatggagtttgagacgaataactttccagatccgagcaaagtcttgatgtttaagaggaggagggggtag

SEQ ID NO: 336 - DNA, 1212 bp, Pseudogymnoascus pannorum
atggctctgcctctcaacgctaccccggttttcctcctcctccttgtgaccctctgggccgtcattgctctatactatttctccgccatcaacggcttctttggccaattcggagccgccctagattctctaacacttctggactccactcccttccaattcctcaacaccaatggcacctatcctcgcatcgactctcaattgcgcgcagtattaattttcggttgggtctttgctggcaatggctcaaatccagaagcttcgttgactgggtttttctatcttggaaattggggtgtgagctggttcctggtggtaatggagacactgaggagcggcaacaaacacaaattaatcgcttttgattcaattctcggcgtcttggtcttcaactgggcccatccggtcatcatgccgatctatttatctctccacctcttaacctccccgacagcatcgctcccaacccggagcaacgtcgtcatagactcaaccgacctcctcgctctccctctgagttttgttattgcctataccatgccaattacgctgctctctgttccgccttccgcctttggcatggtattcaaacaaaacatcatggcgtggtatcaacaatggaacctctacatcggcctcacccactttatgctagcctttactctccgccggctcctctccagttctcaacgcgattctgccgggaatctcagtccaaggtcgattcataaagaagcgtccactaaatatttgcgacttctccacaccacatacattttcgtcttcgtcatgggcagcatcccctatctaaccactatgacgatctcttgcacagcttccatgtggccttccatctttgcccctagtgtcgcctcgtctctcacgctcgccaatatactcattccgccaaatcccttctccgggcggcagtctgtggatctaatccaaggcgccgtctggattatccgctgggagaacgcgctcgtttcgctcataatgggagtgtgggtgctggctctgcatcgcagggccagatgcaaccagggctcaaaggtggaatggaatgagattataggaatcgtgggaagattggtggggtatacgttggttggcgggccaagtggagtggcggtggggttgatgtgggagagggattgctttttattaaacgcggatgaggcggaggcggagaatatgattagattggaataa

SEQ ID NO: 337 - DNA, 1131 bp, Pseudogymnoascus pannorum
atgtacgggcccgacgcccttaattttctcgggcctctgatatcctcgcaccgatgtgggaggagcgggctcggtgatactggtgatgccggtgccaagcccggaaagctcattccaacatggcttgcacaggttacgatggcggacaagctagtcaaaggctctttggaacgaaaacgcaaagctaccaatggcatgtttgccatttatgctccagaacagcaactgagtcttaaggaaccaatttttacgatgagagtgctatgtctccacggccgcggctcgaataacgagatctttcagatgcaaacagcatcatttagagcagatctagatgacttcgaatgggaattcgttggaggcacgaccctacataccgaagggaactggtctttacacacagctgctttttccaatcttcccctatacagctactacaaccccctgtcgccatcttctatcattgaagccgaaaatgacatcctccgcatcacggaagaagaaggaccgtttgacggcgtcctaggctactccggcggtgccgctcttgcttcccagattataattcgcgacgccattgcccatccttttaagtctcccaatgaatttccatttcgcttcgccattttcattaacggtgcgtcgccattgcgagctttccgcctctcaggtccggctgattgtctcggcgatggcacgaccaaccccgaagatttgataaaggaggcagagggtatgttcctgcgtgcatcagcaacacgaaagaaaaatggcgtaaatgacgaggatcaacctgatagggaggcattgttgcgtgcgcttgcttccttcaaaggacatgtgttggacgatggcacaccgtttctgacagatggggagtatgggctgacgaggtggaacgccagaacagaaattgtgaaagataaaggagaaatcttaatttcgatcccgacgctccatataaggaatccggcggaagaggacatgcaccatggagagcatttgttgaccatgtgtgagccgggtctgaggagagagtaccaccatggctacggacatgactttcctagaggaagacgagaaatgaagaagattgccgagttgattagagagactgcagagagagcttag

SEQ ID NO: 338 - DNA, 4641 bp, Pseudogymnoascus pannorum
atggaggcctccacaagacttgatggtatttttgaaaatgttaggccaaagagtactgcacttactgttgtcctgatggcgatttgcttggtgtcggtggtattactcgtgacatggcttggaactttaatacgatcatggccctcgaaaccaggcttaggaaaggaaccgcccgtcgcgccatatagcatcccgtatcttcaacacatgatatcgtttttattggatccatatgggcttcttcaatctctaagggagaaatatcccgaatcaccctttactctcacaatgatgaataccaagttccacgtattcagctccccagaaactgcggcaaagatattcggcaaatctcgagagtatgcctttgagcctgtgattgccagtatgatgcaaaacggcgttaatctgccaccacaagaccttgcgaagttcacactccataagcgctcccctgggtcccattccggaaaagaggatgacacaggagaatttgtttctttaaatcacggcgtgtacattaagtatttatctggaaagcggttggaaaatatcatgaaagtctacttcaaacatttcgcagccgtattggcgacaaatccaatctacaacagcattagagaagattggaagactgtcccgctaaatgcgacactgcaaaagataatattcgacacctcagctgtcacattttttggcacgcgtttacagcagctttggcctgatatgtggcgtgattttaaactctttaacgatgctgcatatgcaggagtgcgctcgaatatggcttttgttctccagcccagagcatatctagctcgcgagagaatgctgaaagcattcgagaaatgggtggattgcgaagttgaagactgggaggaagccagcggcatctggagcgaaaaatggggaatcagaatgaactgggagcgggagaagatggcccggcagtttggttttacacatcgagggcgagcttgcttgcaagctggttttttatttgtgattattacaaatgcagcgccgatgacaacttggctcttgctttgcattatacaagattctgggcggttagcccgctttcagcaagaagctcagactattctacttcctcctggcctagctgcggacccaaatgatctccgttttgatatttctaagctgaaggctaatatatacatccaaggaatatggaaagaagcgttgagactaggctcagccactgcggcagccagagttgtcgttgatgacgcggagatcgaagggtactttatcagaaagggaagtgttgttctccttcccgttgcattgatgcattttgatcctatcatatttccatcgccctcagcgttcaaacctgagcgatggcacaccagcctcccggaaagtgcaccagaggacgagaagcagctagccgcagatagggcgaggaagcagaactcgagtttcaggacctttggtggcggaactggcttgtgctctgggagattcgtggcagagcaggaggttctgactgcagtgtgtaccctgttgctgctctttgatattcagtttgagaagggccatgaaaacttcaagttgaatcaccggactctaggtatcatgagtccaaagacgctcttctgcggagtaggtaacacccagtttctcaatggaattgggtccgcactgttgaatctccccaacctgcaatttttggggttaatcacgaataatgcttcagatgacggattgactaggcaatcgcctggtcaatatttatattttccgaagcaagacgagaatgactcccccaaagggacaaattttaataatatcacgtggactctcaccactaattctttcaacccaaatcattatcaaactgctccatatgtgtccaatggatactttgggcaaacccttccctcagagggtgtgggttattggatcgagagaaacttctcagcgctagaaggtagttgggaacttaatggctggcctttggatcaaccacgtgcaacatttggcaccattgccgggttttggaatcttcaagaaaaagtcacctatcctagtctcccagaaaacagtttgagaggaggagagtctgtcatcagtggtattcccgattggacaggcctggtcatcacgacccaggagggacacagttacaaacctggcgtcgacaaatccacggtcttgacgtatagccagagtacgtctctgcaaaatggaataatccacacgaatgtgacgtggaagcccgatggcgaggaaaccatctttcagctgaattttacagttattgcacatcggacgcgtgttaatctaggtctcgttcgcctcgacctagcagttagcaaagccgcaaagttcatcataaccgatataattgatggggctggggcaaccagggcccattttggagacaaagagatcagggccactgatgatctgatgtggacgagtgtgaagccgtggggtatagagaataccacagcttatcttgcttcaacagtcagttttgggggtttaagcgaagatgctctcagcaaactctccgagacccggcaggacgggtcggaccacccatgggtttcgcgaaatttgagcaccattgcgcaaagctgggaatgctccgcgtctagccagcagagacttagtgtctttaaatatgttggaatatcctctagtgatgcatttcccaaaaacacgcagtcaacagcatttaatgcggccttgcaagcgaaaaaaagcccttgggggcagctcgtgaaggaacataccgatgcttgggatgctacttgggaggatgctgatgtgcaaattccaggagacgaagagctccaaatcatgacccgaggatctctatttcatctcatggctaattctcggcctgggacagagccacacggtctcggggacaattccattatggtcagtggcctgtccagtgactcttacgctgggttggttttctgggactcggatgtgtggatgtatccggcactcctttctctattcccagatcacgccatgtcaattaacaactatagaacgcgacttcttggacaggcgattgaaaacgcgcagtcatataactactctggtgcgacatttccttggacaagtggaaggtttggtaattgcacagctactggattatgtgttaattatcaaattcacttggatacagatatcgcgctggctcattggcactattaccttcataccaaagacagggaatggcttagagaaaagggatggcctatcattggaaatgttgcagatatgtttgcaaactatgtcgtgtggaatacccggaacaaaaagtatgagacaaagcttctaggggagcctgatgaattcgcatacaacatagataacggcgcctatacaaatgccgggatcaaaatgctcttaggagaatgggctccttctgcagcgagagttctcggcatctcaacgcccagtaactggtccgaaatagccgaaaacatggaaattcctttcaatgagaaagagcagatgatcatcgggtttgatggaatggacggaacatggacggtcaaacaggcaagtgtaacattgattacttacccactgggatggaatatgaacgaaagacaggcgcaaaacgatatgacatactattcagcgaaaaactcgcccgacggtccagcaatgacctggtcgatgttcgccatcaacgaagcacaactccaagagcaaggctgtgcggcatatacctaccttcaacggggattgtatccatatatccgggcaccattcttccagttaagcgaacaagtttccgatgattggcatacaaatcagggaacacatcccgcatttccctttctcacaggatatggtggatacctacaagtacttactcatggcttcactgggttccgtgcccaggaagatgcattctttatggatccaatgatggtgccgcagatacccgaaggtatcaaaattaacggactaaaataccaagggagcgtgtttgacgtagagatcggattagaaaactcgaccattacaagaaaacgcggctctggtgcgtccgggtcgagaactatgagcccagtcatcgtgcggataggaggtaaggcgtacaagcgaggcgactatcttttagccgttggagagtctctgacccttcagactcgtcgaccggacttaaacgggaccgtcattgccggaaaccttgctcaatgtcgaccgatatcatccgaacacaagtgggtgccaggaagtataccccaggccgctgtcgatggttcaaacgccactacctggcagccgttgactccccaactcgcttctcttaccattgatttaggcagtatctaccgtgtcagcggagtatcaattaactggggccctacacctcctacggcctttactatttcagggcgtaacaattcagaaagcgagtttgcagatatttttatgactgaggacattgcaatctcggaaccatatctaggaccggaagaagcgaagattgtcaggatcagaccaggaaatagtacgatgtatctgtttggagaaattcatcaggcaagatttgttagattgagtattgaagggactcaaggcgatgataagagtaccggtgcgactgtggctgaagtagcgatactataa

SEQ ID NO: 339 - DNA, 7917 bp, Pseudogymnoascus pannorum
atggcttcagtgccaaatggtaacggccacccggccagcatatccgacaaacaggaaccgatggccataatcggaatggcaacccgtttccctcaagaagctaccaacacagagaaattatgggggtttttgttgaaagggaggtcagctcatactgcgtttccaaaagacagaatcaatccggatggacactatcaccccgaccccgagcatggaggcacatttgccgtcaaggggggccattttctttcagaagaccccgcatattttgatgccccgttctttggcatcacaaagacggaggtcctctctctggatcctcaacagagagtgataatggagaatgtataccaagcgcttgagaatgctggtcttccaattgccaaagtgaccggaaccaacacgtcagtctacgtttcgggattcaaccacgatcaccttgcaacactcaattccgatcctgaaacgaccctgaagtacaagcccacgggcacgacgaattctcttttgagcaaccgcgtttcgtggtttttcgacttcaaggcaccaagtttaaccttagatacagcatgttccagcagtatggtagctctgcacttggcttgccaaagtttaagatgcggagctgatgctgagtttagtccgtgcatggggcatcacggattcctctcgcaggaaggacgctgcttcagctttgatcatcgtgcggacggctatgcccgcggcgaaggggtaggtactgttatagtgaaacggctctcggatgcgctcagggacggaaacactattcgagcggtaatacgagggactggtgtcaaccaagacggacgaacagccgggatttctcttcccagcagtgctgctcaggaaagactcatgagaaccgtctatgcaagtgcaggactggattttaatgacactatgatggtggaggcacatgggacgggcacagccgccggtgatcctattgaagctagtgctattgctcggacattcgcgtcaaggagcaaagatattccactgtttgttggagccatcaaatctggaattggacatttggaaggcggtgcgggcattgctggaataataaagagcgtcctggtcctagagagtgggataatccccccgaatgtgaatttcgagaaggccaaccctaaaatcccaatcgaagcttggaatcttcaatttcctttagtaaacacgccgtggccgactcctggcctgagacggatatctgtaaattcgttcggagtcggcggcacaaatggacacaccgtgctcgatgacgcatataactatcttacttcccgaaatctaacgggtgctcataataccaaccatcatactccaacggccgaagaaataagagttaccgtggcggagattgatggctctatagccctagaaaccgaaatggacgccccaccgaacggccacgccaatggaacgtctaacggggcaactaccaacggcaatcatgataccacagaaataactaacggtaatggtgttcaaaacggcaacggagtcaataataatggccactttgcccctcatgtccctcgcctcttcgtcttctcttctttcgatgagaaaggggccaagcgaaacgcaaccacatacgccaagtacctgaagaatatccagccccccaatgaagatgactacatgaaagatctggcctacaccttgtctgaaaaacgctcggtattcccatggagaagctatgcagtgtctaactccttgtcggaactgattgagaacctgtcaagtgaccagggaatgccaagcgctgtgcgggtagggacaccacctaggattggctttgttttcaccggacaaggcgcgcaatggtacgctatgggtagagagctgttgatatataccatttttaggaagagcctcgaggacgctgaatcatatatgaagtcaatcggcgcggaatggtcgctgctagaagagctttcccggagcaaagaggagacaagattaaatgagccgcatctggcacatccgtcgtgcacagccgtacagattgctctcgttgaactacttaccagttggaacatccgacctacgcgagtggtcggccactcctctggagagattgccgccgcctactgtgcaggtaagcttagtaaggaagccgcatggaaggttgcatatttccgcggctatgtctcagcgaagcaacgtggagcaaaaggggctatgattgccgttgcgctgtccgaaactgatcttcagccgtatttgaaaaccatcaacgagctgcatgagggggagatgataatagcttgttacaatgctcccaagaatcacaccatctccggggatgaacacaagatcgatgccctcaaaactctcttggatgataaaaaggtctttgctagaaagcttaatgtgctcaacgcttaccactccgggcatatgaaggcccttgcagacgagtacctagaacgcatgagcgatatctcttttggcgatcgcctgtctgtggcagatattcacttgttctctagtgtcaatggccacaaagtcgagaaagacactctggatgcgcaatactgggtcgacaatatggtgtctcctgtccgatttaccgatgcgctgttggcaatgagctttactcggctatcgaagggacaggcgtcgttgcgtttgaatgccggcactgagaacatcttcgttgatgctattgtcgagatcggacctcatgctgcattgcagagcgctatcaaagatacactggcaaccaaagtcagcagctcctcgttctcatacttgtcagtccttaacagaacgactcctggcgctcagattatactcaatagtgccggagttttgtgctctcgcggttcgcccgtaaatatccaggcggtgaatgattcagccaacccaggcgccaccgctccacggttgatcgtccaactcccaccctacagcttcaatcactctgataaagtctggtatgagagcagactaagcaagaactaccgcctccgcaaatatccgcggcatgacctcttcggggctcccgtctctgactggaacagtgagagaccccactggcgccatattatcagactctacgaacagccgtggctcagagatcatatggttactgatgcctatgtttatcctggagtcgggtatattattgctgttatcgaagcctctaggcagatagcagatccggagatgacaatcacggaattccgcctccgtgacgtctctctgaaacgagctctcattgtccctgacaacaaggaaggtattgagattaacctttcgtttgctagaatggacgaatccagcttgtggggttcgtctgtgtggaagaaattcgtgatctctagctggaatcccactggaaacgattggatagagcattgtactggttatgtcagcgttgattatgagacttctcccaatcttgtcgatgctggacgggaatcagtggccgaggccctcaagtggaaagatacactggagggtgtcaaacaacgatgcgttatacctttcgatattgacaccacctacgacaacctcattactagtggattggcctttggccctctcttcaaaaacctatctgacgtacgaggaacggccgatgcacgtggagaagtttttggcttggtcactgtgccagatattgccgcagcaatgccgaaaggcttcactcaccctcacctcatccatccagcgacaatggacagcatgatgcacttcttcatcgcctcagtcatggaccacacaggtaagaacaccctacggacggcaatggtccctacgttcataaaagacgtgtggatctctgcccaggtggacaataacccttctcataccttccgtggacacggaaagtctactttcctcgcatatgacaaataccagagcgatgtcatggtatgggatggcgccacagacgaggctcgtatctcaatcaaaggaattcgcgccgctcctctcgaatcgattgatagcggatcaggcgagtcccgaaaactctgtcataatatcgaatgggggctcgatgccgatctcctcagccccgcatcattccccgccgttgtccacgccactcatgaagataatcttgattacaagtactggatcaacaggttccagcttgcaaccttgttgcgggtcactgacgctctctctgctctgggagacttcaataccgatgtactagaaggccatttcctaaagtactggaactggttgaagcaactagaagagtggctgcacgctgatcagatcagcggtatgaaattgagcgactggacagagtacaacaatgacccgtcgctcaaggcacagttatttgaagaagtcgctgcccacaatgcggatggtgcgctcgccatgcgaatgggatctaacattacggcagttcttcgcaaagaagtcgacccgttgcatctcatgtttggtcaagacgatcttcttaaccacgtgtatgagcaagtcgtcaagttaggcgatctgccaaatcttcaaaaggcatatctcgagatcgtagcgtataactccactaaccttcgtattttggaagtcggtgctgggactggaagctcaacagctgcaatgcttgacgggctctcgcagagtactgacggcgggaagaatatgacttcaagaatcgaaacgtatacctttacagatgtctcgtctggattctttgagaaagctcaggagaaattcaaggcatacaaaaatattctagagtacagaatattaaacgtcgagaaagatgtctctagtcaaggattcgatgttaaaagttacgacttcatcgtggctggaaatgtcattcatgctactgccgacatcaagaaatctctcacgaatttgcaagagcttttgaagcccggcgggaaactgattctgcatgagggcattagacaagattatctatggtcgggcatctcttttggccagttgccgggctggtggctaggtgttgaacctatccgtcagtggaacccttggattacggcggttcagtggaatgtaatcctgaaggaagcgggtttttcaggggttgatcttgacctgccagatcgaaaggacccgaaccttcatacgcaaagtctcttgatcgcaacagccgttgagccctctggtgcaatgccccagaccgtcatcgtgacaaccaccccttcttgcgattccgaactgatcacagctctaaaatcgcatcttgagttcaccctcaaaataccaaatgtctgcaccgtgcactacctcgatcttggtaacaccgacctcagcaaagcagtctgcatctccgtcatggaactcgagcgctccgtcctctcaaccctcgctatgacagagtataacaacatccgccacctccttgtcacatgtgtcggcatggtttggattactggcgacacactcaccaacccatccttcaacatgatcaccggactgacgcgcactgtgcgctgggaacgcgacattgacgaggtaaatctcatcactctctcagtgtgcgaacctaggcccgctgttagtgaccttgtatcatccattgggagactatacagccagcaatttatcgcaacgttaccggctgacaagatcaacagcgagtacatgctgcgccacgcatcattcttatcagcgcggctcatggactcagacactggtaatgattatctgtcttcaaaaactgtgcggcccacacccgtgctccaagagcttagcaaagccggaagaccgctgaagctggctactgcatcgcctggacagctagacaagctggagtgggtgacagattctatttatgctgagccgcttagtgagacacaggtggagattgagatcaaggctgtggggttgaattttagggatttgatgattgcgatgggtgagcatatggcgtatagtcttggaaacgaagcagcgggtatcatttcccgcgtcggcttgggcgttacagcctttaagccgggtgaccgtgtcgtttacatgtgtggcctagagagcacaggttgcttccagacatatggccgcgtcgatcagaacgtggtggttctaatcccagacagtctcagctacgagattgcgtgcagtttgccttgcgtatactccactgtcatttatgggttaatggatgcggcaagattgctaaagggagaaaaaatactgatccatgcggctgctggaggtgtcgggcaggcggctattaacctctcgaaaatgattggagcggagatcttcgcaacggtgtcgacgccggaaaaaagagcgctccttgtgaaagagtatggcattaatgaagagcacatcttctcgagccgagatctcacgtttgtccaaggcataatgcgagtcaccaatggcaagggcgtagacgtagttttgaactcgctttctggagaggctcttcgtcgctcttgggatcttattgctccctttggccgcttcgtcgagattggtaagaaagacgcccaagctaatggcaagattgaactccacccgttcttgcgtaatgtcaccatgacaagtgtcgaactacccacaatgatgcgccatcgacctcatcttattcaacgactgacggccgacaccatcaaactatatgacgaaggtaagattaaggaggctataccaacgaatgttatgggttatgatagaattgaggaaggattgaggatgttgcagtcgggtaagggcatggggaagatggtattccgaccgtcgcctagtgatatcgtgcccattgtccccgaacaaacgactccttaccgagttgaagcggatgcaacttacgtgcttgctggtggactcggtggcatcggtcgtagtatggcgaagtggttggtagagcgtggagcgaagagtctggtgtttctttcgcggtctgggagggtcacagatgctgtgggcaagatgatgttggatttgaagacggcgggatgcaatgttaaagtcttcacttgtgatgtgactgacaagatgaggcttgcggaggtgatggatgagtgcaaggttaccctgccaccgatcaagggttgcattcaagggtccatggttttgaaggacgttatgtttgagaatatgtcgtacgatacattcgaggcagctgtgaagcccaaagtccaaggctcctggaaccttcacgagctcctacctgcaaacatagatttctttgtcctcctctcctcggctactggaattctaggaaaccgcagccaagccaactacgccgccggcaacacctaccaagatgccctagcaaggcaccgcatctccaaaggtcttcctgcagctgtcatcgatcttggtaccgtcatgtccgtcgggtatgttgctgaaaataaagaaagggccagtatggccaagcatctcggaacggtgctcgaagtactccgcgaagacgagatacatactctcatcgagtacctcatggatccgcgctcgaaactgtccgagttatcatgccaactcgtctctggcttgactaccgcagccatctaccgcgaacgtggaatcccaacaccgacgtatctgagctaccccctcttcacccatctccgtacggcatcaagttcgcgaagtgaaggctctgaagaagacccctcctttttggtacaggcccagctgcgtgccgcgacgtctctcgaggaggctactgcagtcgctgccaatggcgtgcgggcgaagctgtcgtctctacttgccgttccacaggacaatatcgacccgacaaagtccatcagctccaacggtgtggacagtttggtcgctatggagttccggacctatctaacgaaggatttgggcgccgatgtgccgttgttggatatcatgggcactagcagtattatggtgctaagtcagaagattgcgagtgtgagtaagttggtgttgatttcggatgagaaggagacttga

SEQ ID NO: 340 - DNA, 2013 bp, Pseudogymnoascus pannorum
atgcttctcctcgaatataagcatggatctgaggcgaccagcacgctcaccacttccaccaatgttgacacctttctacttagcctccttgacgaccgcatcatgccttgggctgtcaaaggcaaggaatgccccgcagctcttaccacgaaggttgaggatctcgccagggtatcgggcactgaccctttcaatgccgctacagaggcacttgccgaccttggcgaatttcccggtagcactaacaccagtctggacctcgttaacgatgagaatgacgttgtgcttgagagtaatgattggctcaactgtcacagctgcgacagggttgttgtaggaggtgatgctatgctcagcgtcttcaaggcagcgcgtctcctcggcagaattcccagcctcgtactcgtggagggggtgctggggcttagggaatggtgtgaatggccagtcaaaagccggaatatcgagcttgtggatagcattgctacgggtagcagaaagagtggatcgattctgctgcaaagctcccaaagctcccaaagctgccgaagctgccgagctcccggcgacgacatagctctcctacccctcaaaaaagacaagaaaaacatcaccaatgctttagtaggaaggcggggtatgattgccgcctgcgcagatcctttcgcctttggtgtcgcgcatttaggcaaatcgcagagagggggaagcactaagagaacaccgcgaataaatagtatggggttgaagcctagtgaaagtaagactgccatgattctatgttcgacgcagaaagggaagatattaagcactgtcagtgctgaggataataccatcgtcagcaaatttctcatatataacaggtggctcggcgtcgctttgtttgccggagtggcatataccacgccttctcatccacatcatcctgagttcttcaacaaccgcgctatcttcaccccaccacaaggaaccaaagcttcctacccccgtattgtcgagttgtccgatggaacaatactagcaactatagcttggaggaatcccgatggagacctcccttatttccccatattccagtccaaggacaacggctggacatggaagcacatcagcaacttaactgacgatgttaacgggcttggttttggctctcagccagctcttgccgagcttccttacaagatgggcaaatttcccaaaggcacagttcttgccagcggcaacagtgccggtaacacgtcgacaaacattgacctgtatgcaagccataacaagggcaagaagtgggagttcgtcagcaatgtggcacgcggtggccgaccaaacaccactaatggagccactcccatatgggagccgttcatcttgccatatgaacacaccatgggactcttctactctgatcagcgcgatccacttcatggccaaaagctagctcatcaggagtcaaaggatctcatggactggggcccagtgattaatgatgttgcatacctaaattataccgatcgaccaggcatgacatctattgcccacataccaaccgtagataagtggatcttcacttacgaattcccggaacacgctggcggcatcaactggtttggcaaccaataccccatctactataagattgccaataacccccttgacttccgctatgccgacggcttccccctcattgccagcgacagtaccggcaatggctccccatacgtcgtctggagctccgttggcggcggcaacgggaccctcatagtctctgacgcagatacgcaggacgtctggaccaaccaggaggtcggtcgtccagacaagtgggtgaagcgtcctcagccgggcaagtcggcgtacagtcgcactttacacatttctcgcaaaaacccagaccgtctttacattttcagcggcgcaacgtttgacgatgttgctagtgggccacagatcccgtacgttgttactgcattgagcgtgaagaagctgctcgctggtggatacactaatagcggttga

SEQ ID NO: 341 - DNA, 861 bp, Pseudogymnoascus pannorum
atggggtttgcatgggttcctgggaagctagtggcactagggtatttattattgaggggtagcacccgacttgtcgcggccttgggtgttttacgtaggtgccggaaggctgtcaaaccttgtctagatttcggaagtatagacgcttttgagaaactattcagtgccaaaagttttcatcatgtccaaacaatatctcgaaagctcttcagcctctcctacgaagagaagatggtagcaaaacatccgcccaagtcaaacccgaacaggggttacagctatgtcggtcaagagaacactgtcatccttagaggatacaaaagtggacttggtcctggcaagactcgggatgtcaagaggaatcattcgacatgggagccgacaacgatgaactcgtctctaatccatggaatgaggaccttcaaaaccgagctcaatatcttgtcggcacttgccagggctctaggaattcccgatgttcacctcacgtctcttcattcacgggcagagaatgagttcagattacttcactatccaaccgtacccctcgcagagttcaagaatgggactgcaactcgcattgcggagcataccgatttcgtacaatcactacggtattccagggttccacaggcggactgcgcctgtcaccgcgtcacctttccaccaaccatcaagggtgacaacgatgatgagatgcttcctgaaaggtactccgttgcatactttgctaaggcgacctacaatgactctctactcccattaaaggggattattactgaggcaactccatgccgttacaaggaggacataacagcctgggaatggaacaacctccgtattggaaacctgtaccgataa

SEQ ID NO: 342 - DNA, 4137 bp, Scedosporium apiospermum
atggatcgctttcgcagctataccgagccatgggaccccatccgatatggcatctgggccatctatgcccaatcaaaagaggcctttttcagtggcagataccccgatctttttaacctcaaatatctcctagactcggggttttatttgtggtttaaagttctgaatgagcatttttgccgctttgagcaaaatcaaaccactatcccagttcttgtcccagcttctactggtgtggtacttgagctcggtcccggaatgggtaaccaactgcaccgcttcgacaggacaaaggtgactcgtgtcgtgggcgtggagagcaactcgcacttcacacgagatattgagacacaggtcaagaaaaacggtcttgaagacatttacgagctcgttacatgccgtgtggaagatagcgacgtgctagaaacgcatggtgttgttgccgagagtgtggatactgtcctgagcatccaggttctgtgctcggtggacaacccggaagccgttatcaaggagctttaccggctgcttaagcctggtgggaagttcatattctgggagcatcaccgtaactcggaccgtactactgccgcaatccaatttcatcgcctcccgatagacgtggtcgggcgctctaagatggacgacctcttacagctggagcagtttgctctggcttccaaagtacaagccgaaattaacaaccacacaggcgtctccgacaagacccttgccgaattcatcatcgcccagcggctcgaatgcgaagaccttgccgctttcaagcagaggctaaaatctatcggcgccgatttccctacgagtttggtcgagagtatagaccggctgtgcaggtcactacacccgaagctcaagaagaagcaaggcgccgcgaacaagatcgaagaggaagagcatccgacgcgaagtaatgaggagaaggcaaaaatattttcagggttggcgcttcctgacaaggaagtcccgcctgagtcgaatggcgatgcgatagatgataccctggcgcagttggagagtttaggagggaggccgcgcaagccgaaagagtcgcgaaaacgttcacggtcccccgaagacggcgacagagattcgaggagacgaaaccatagagaacgagatcggtcacgcgacagatcgcgagaccgagattcgcggaggaagagatatagatcaaggtcgagatcaccaccgaggtaccaaggagaactggaccccgcgccgattatcgacaagatctatgacggaaaggtcacgggcgtcaaggattttggcgcatttgtgtccctagaaggtatcaaggggcgatgtactggcctaatacatatatcgaggctggccgaaggccgacgcattggccacccttctgaggtagtatctatgggtgagcccgtcaaggtcaaagtcgtcagcatcgaaggaaacaggataggcctgtcgctcaaggatgtcgaccaacacaccggtgaggatctcgcggccccggctcccgcctttggatccggtgccaacatggaggccttgggaagccgacatggcttcgtcgaccagcccacatcattccgcaatccacagccgccgaggcacaagaagcaattgacagattcggacagatgggagatacgacagctcatccgctccggagtagcgaaggcatcggactttcccgaacttgaggaggagacgaaagcagtccataaggaagacggtggcatggagctggaggaggatgtcgatattgaagttcgagaggaggaacccccattcttggttggccaaacaaagcagtctctggaactttccccgatccgcgttgtcaaggctcctgatggttcgatgaaccgagcggccgtaacgggatcggcgctcgtgagggacaggaaggaagctcgccagcaagaggcagatgcggaagcgcatgcagcgcccaaggatgacttatccgcgcagtggcatgaccctatggcagacccggataagcgaacatttgcgagcgagctccgaaaggcccggataaacgcaaagtcggatgttgtgccggagtggaagaagaccgtccagaatagggaccagtctttcggaaagcgaaccaaccttagcatcaaggaacagcgagagggcctccccatattcgcctttaggtcacagctcatcagtgcggtgaaggagaaccagattcttatcgttgttggtgagacgggatccggcaaaaccacgcagctcacccagtatcttgctgaagcaggctttgcaaatagtggcatgattgggtgtacacagccgcgtcgtgtcgcggccatgtctgtcgccaagcgtgtctccgaggaagttggctgtaagcttggcgaggaggtcggatacacggttcgtttcgacgacactaccactccttcgaccaggatcaagtacatgacggatggtatgttacaaagagagatcctcatggatggcgatctgaagcgctactccgtcatcatgttggacgaggcccacgagcgaaccatcgccacagatgttcttttcgcccttttgaagaagacggtcaagcgtcggccggacctcaagattatcgtcacctctgcgaccctcgacgcagataaattctcgagctattttaacgaatgccctatctttacgattcctggacgaacgtaccccgtggaaatcttatattcgagagagcccgagagcgactacctcgaggctgcccttcttactgttatgcagattcacttgacagaacccaaaggagatattcttctcttcttaacgggccaggaggagattgacacctcatgcgaaattttatatgaacgtatgaaagctctgggtcctgatgtgccagaactccttattctccccgtttattcggccctgccgagcgaaatgcagagtcgaatcttcgaaccagcgccgccgggaaccagaaaagtcgtcattgcgacaaatatcgccgagacctccattaccattgacgacatctactttgtcgtagatccaggcttcgtcaaacaaaacgcgtatgatccaaagctcggtatggactcgcttgttgtcacaccaatttcacaggcccaggcaaaccagcgagcaggtcgagccggccgaactgggcccggaaaatgcttcaggttatacaccgaggcagcgtaccaaaccgagatgctgccgacgacgatcccagaaatccagcggcagaacttgtcgttaactattctcatgctcaaagccatgggcatcaacgatcttatcaactttgacttcatggacccgcctcccgttaacactatgcttacagccctcgaggagctgtatgcgctcagcgctctcgacgacgagggcctgcttacccgcctcggacgcaagatggccgactttcctatggagccgtcactcgccaaagtcctaatcgcctcggtcgatctgggctgctccgacgaaatgctcagcatagtagcgatgctcggcatgaacgtcttctaccggcccaaggagaagcagacccaggccgaccagaagaaggccaagttccacgatccgcacggcgaccacctgaccctgctcaacgtctacaacagctggaagcgcagcgggtatcagaacgcctggtgcttcgagaactacatccagcaccggtccatgaagcgctccaaggacgtgcgcgaccagctcgtcaaaatcatggagcgctaccgccatcccatcgtctcgtgcggccgcgacacacacaaggtgcggcaggctctctgctccggcttcttccgccactcggcgcgtaaggacccccaggaaggctacaagaccctcatcgagggcacccccgtgtacctgcatcccagctcggcgctgttcggcaagcaggccgagtgggtcatctaccatgagctcgtgctgacaacgaaggagtacatgcattggacgacggtcatcgagcccaagtggttggtggaggcggcgccgacgtttttcaaggttgcgccgacggataggctgtcaaagaggaagcaggctgagaggatccagccgttgtttaataggtttgagggaccggatgattggaggcttagtgcgcagaggagggttggaaggtctggtggtggtggaggtacttggggttag

SEQ ID NO: 343 - DNA, 1248 bp, Scedosporium apiospermum
atgggctccatgccgaataactcagaaccaatatcagcgatccttgatgccatcggtcatgtcacgtcctctctggccgcctacgagcgggtaacgaggaagtacggtggtagtgaagaagttgcccataagggcgagattgcagttgcacgcaatgccatgaccaaggatgctatccagcttctccaagaaattcgtgggcccattgataccgtttatggattcttcgaaatgggatcccaagcatcggctattcgctgcctcattgcaatgggagcgtttgacaagattcccactgaaggcagcatcactgtagccaagctggcatccgagctcggtgttgaccagaacctgctcacccgtttgatgagagttgtgagcgtcaccggacccttccaacaagtgcgagaggatgagtatgcccatactgctttctccaaggcttatctgatcccagaagtccgaggaatgtatactctgatattcgacgaaatgtaccccccgtgggtcaaaatgcacgagtttctcgcctctcgcggttggaagagtgatggggaggagagagataatgcatacacgtatgcgcatcaaaccggcggcaagagcttctgggagcatctgaagcagtatccaaagcgtgtggaggctctcaacctcggtatgggagcacagactgctacaaccatgtggtccgtggacattgtcgacttcagggccctgctggcatccaagaagacaaacaaggatgacgtgttggtagtcgacgttggaggtgggaagggacactgccttcagaggatcaacaaggctatctcggacatcgagggccgcctggtcctgcaagatcgtccagaggtgattagcgatacgtacgacttggattcttcgcggatcgagaagtacgagtacaacttctttgaacctcagccaatccagggcgcgcatatatactacatccgtcgcgtcttgcatgactggccgaatcatctttgcgtcgacatcctgaagaacattgccaatgcgatggagcgcggaaagtcgcgtttggtcatcgcagaaatcgttgttcccccaactggaggggattcggaaactgggtggatggatctagttctaatgactgtcactggtgtcgagcgcagcgcaaaagactggcaagaattactcagtgccgcaggtctcaagctggagaagatctatacttcccctggcactaaccacggtgctgtccaagccgtccttgcatga

SEQ ID NO: 344 - DNA, 915 bp, Scedosporium apiospermum
atgagtggggagcgtaaagatgttgagttcaaaactctggatggcttgaccctgcgcggctggttgtttcagggacccaagggcggtcctgcagtagttgtcaatggtgcatttaacagcccaaaagagatctttgtagccagcgtcgccgaatggttcgggaagaacggcgtgacggctctcgtttacgacgcccgcacgctgggccagagcgatggcctgcctcgaaacgacctcgacccgcaaaagatggcggaggacaaccacgacgctgtcactttcctgcaagatgggggatgggtcgacccagaccgtatcgccatctggggcttcttctatagctccggcattgcgctcgaggctgctgcttttgacaagcgcgtcaaggcggtcatcgcacaaggtctgatgccggactggtgcctcaacccgccggacgaggctgccatagttgcgagtgcggtcgcagatcgggctagccagcttcgtggcaacccgcctcagtacatcccccttctcaacgacaagggcgagcacctgatgcacttcaagtatctggccgagatgacccccgagcagaagcaccatctccccgcctgggtccacggggccaagaaaaacgccccgagcttcaacgaccacatgacgatccagagcttctaccgccatgctaagtggaagccaatgaatctcttcgcggccgtcaacccaaccccggtcatgattctgacgcctgaggacgacgagatcgtgccgcccgcattccaacggcgcatttttgatagcctgcagtcgccacagaagaggtatgagattgtaaagggcagaggtcacatgaactttttgaaggatgtaaactttgatgagctcttgggcggccagctagcgttcctcaaggaggtgatgaagttctga

SEQ ID NO: 345 - DNA, 960 bp, Scedosporium apiospermum
atggctgccgctcctgctgcggccgcagctaccatcccagctcccaagagcaggccggagggcatcgatctctatgctcgcttcgctctcgctggtgctctgggctgctctgtcactcacagcgccgtcaccccgatcgacgtggtcaagacgaggatccagcttgaccccgtcacctacaacagtggcatgattggtagttttcgccaggtcatccgcaatgaaggcgttggggccctcgcgacgggcgtagggccgacttttgcgggctacttcttgcaaggcgccttcaaattcggcggctacgaattcttccagcagaagctcactgataccttcgatgcggaaaccgtcaagcagaatcgcaccgccgtttacgttgtttcctctggcagcgctgagttcttcgcctccatcgtcctgtgtcccctggaagcgacgcgtattcgccttgtttcgacacccgactttgccaatggtctggtcggtggtttcagcaagattctgaagaacgagggcattgccgccttttattctggtttcggtcccatcctcttcaagcaaacaaaaaaaaaaactaaccccgcgtacatggttccttacacaataaccaagtttgtcgttttcgaaaaggtttccgaggccatcctgagccagtttgacaagtcgcaaaggtcggccggtgcatcgaccgctgtgaacttgggatctggtctgatgagcggttttgcggctgccattgtgtctcagcctgccgacaccatgctgtccaagatcaacaagacgaagggtctgcctggtgagagcaccgcctctcggttgatcaagattgctggcgagcttggtcttcgcggatctttcgctggtctcccgacgcgtctgttcatggtcggtggcctcactgcgggccaattcgccatctacggcgatatcaagaagttcctcggcgctacaaagtag

SEQ ID NO: 346 - DNA, 879 bp, Scedosporium apiospermum
atggcgttatcttcccgcgaagacatcgagtttaagaccctcagcggtgtcacattgcgtgggtggctgtaccctgccgataagcgcgggccgggaattattctttctgcaggattcaacatgcccaaagacgtagtcttaccagaaatcgccgagtggtatcgcaaacgtggctttacggcactcatcttcgacacatacggcatcggcgccagcgacggtgagcccagatgtgatacagacatgcataggcgggttgaggacttcatcgattccgtcacttggctttctcagaaccccctagtagacccggagaagattgtgctctggggtctctgctttgacggcaacatcatgctcgccacggcagcttcagaccgccgggtagccggcgtcgtggctgtggcgcccatgattgacgtgaccggcgaccccgagcgccgtgaggccgtcctcgagcttgccctagcagaccgagccggacagctcgctggcgaggagcccatgtacctgcctctggtcgacgaggacggcgtcatgcctctcggccaggtgtcgggcctcggcttcttctccgccatggaggacatgaacctgcccgtcgagaaccgcgtcaccgtccagagctacatgagggccctcggctggagcatcttgcatttactgcccaaaattagccccacgcccgtcatcatggtaacacctgagctggaccaggtgttccccgcggagaggcaaaaggccgcatttgacatgttgggagagcctaaggaacattgcgttattgctggaaggaatcactttgactggatgtttggggacatggatggcgttttcaacaagcagctcgactttttgcagaagtacttgaaggcttaa

SEQ ID NO: 347 - DNA, 1080 bp, Scedosporium apiospermum
atgaaggctcacacggcaatgaaggctcttgttggcggggagtctggtaattaccggctcgcggacgacatcgatatccctgcccccaagccaggcacgatgctgtgtcgtgtgcattccgtcgccttgagcccatacgacgcaaagattgtagactattccaacacacctggcgctgtgggcggctgtgacttttccggcgtcgtcgttgcggtgggcgaaggagtggtgcggttcaaggcaggtgatcgtgtcctcgctgtgacttttggactcagcgccttagacaagacggcgggtgcctttgctgagtatgctctggcaatcgaagacctgagttgccatgttccggacagcttgtccttgacgcaggcgtgctcaatgggtcttgggattgctactgctggcctggcactcttccaagcacctgggctacagctaagaatgccacgctccaaccacgccgatcaagagacgggtgcttttgttcttatctcagggggtgcaacgggcacggggaccatggcaacccagcttctgaagagtgctggttacatacccatcgttacctgttcgcccgctaacaattccctatgcgagtcctacggcgccgcggcttgcttcgattacaactcagccacgtgcggtgctgatatccgcgagtacacggccaacagtttgacctctgtctttgactgcgtcactgacgcaacgactatgaggatgtgctacgcggccattggctcttccggtggtcaatacgtcgctctagagcccatttctcctattatcaagtacacgcggagggatgtccgcgctgactggctgatggctcccaccgttctggggacccccgtggagcttccgggctcgtatggacgcccgagaactccagagcacagaagatttgcatcagagttgtttctgctggctgagaagctacttcaggagggcgaaattaggaatcatcctctagagattcgggacggaggcctggcgagcatccccagatatgtgaacgatttgcgggttgggaaagtgcgggcaaagagacaggttgtgccattactggcagggtag

SEQ ID NO: 348 - DNA, 8586 bp, Scedosporium apiospermum
atgggtagtaatgccaaccccaactggctcgcgaaggagcctatcgcgatagtgggaagctcgtgtcgttttccaggcggcgctagttccccctcaaagctttgggtgcttctcaaggatcctcgggatatcgtgcaagaaatcccacccagtcgatttgataccaaggcattttatcaccaagacagccaacaccatgggagtacaaacgcaaagtatgcctacctcctgcaggatgacccccgggctttcgaccgcgatttctttaacatcagcccaaaggaggccgaggcaatggacccccaacagcgatgcctcctcgagaccgtttacgaaggtattgaatcggccggctactccatcccccagcttcggggatcatccactggcgtctttgtgggagccatgagcttcgactaccagctcgttgccatgcgtggcctcgacagcctgccgcagtaccatgcaaccggcggttcgatggcaatcctggccaaccgtgtgtcgtacttctatgactggaaaggcgcatcggttgcctttgatacagcctgctcgtcatcgctcgttgccctacaccaggcggtccttgctctgcgaagcggagaagtagacatggcggttgcagcaggggcgaatctcatccttggacctgagccatttattgcttattcaaatctaaatatgctgtcccccaacgggcgatcatacatgtgggattcttctgccgatggatatacgcgcggcgagggattcgctgccattattctcaagactcttagccaagctgtggctgatggtgaccacatcgagtgtattatccgtgaaacgggtgtgaattccgatggccggacaccaggcatcacaatgccgaactctgaggcacaagctcgacttatccgagacacatacaccaagtgcgggctagacccgacgaacccaagagaccgtccacaatacttcgaagcacatggcaccggaacgccggtgggtgaccctatcgaggcgcgggcaatacacgacgctttcttcccggggcatccagaccagaatcatggccagctctatgttggatcgatcaaaaccgtcattggtcacacagagggcagtgcaggactggctggcgtgctcaaggcgtcgttggcggtccagcacggccagattccaggtaacctacatcttcgggagctgaaccccaaaattcgaccattcttcaaccacctccgcatcccgacagagttaaccccctggcccgcgcttccagagggccaaccgcgtcgtgcaagtgtgaatagtttcggctttggcgggaccaatgcgcacgctatcatcgaaagctgggatgggggctacgagcgctatcatgtgtcggaatcgcgtccggctggactcttcgtcctatctgctaactcggcccaggccctggcagcaaaggctgcagagttagccaactatctacgagatcatcccgacacagatcttggtaggctttctcgcaccctgttccagaggtcggaattcccgttccgggcctccttctcagccacgtcggccacccagcttgccgataagctcgaaacaggcacagaagcactcagcaagacgtcacgcatcgcaaccattcccaattcactaccgccccggatactcggtgtcttcactgggcaaggtgctcagtgggctactatgggttgggagctctaccaagcatccgccgtgttccgcacgtcgttggaccggcagcagcgaagcctcgatacgctccccgacggcgatcgcccggactggtccctgatcgacgagctctcggcaccaaaggagacctcccgcgtcggtatcgcagccatctcccagcctctctgcactgctctccaagtggcgctcgtagacgtcctccgcacggctggcgttgagttttctgccgttgttggacactcgtcgggtgagattggtgccgcctatgctgcgggatacctggatgcccgggatgctattcgtgtggcttattatcgagggtttcattctcatctggcacaggggcccggaggaaagcgtggcaagatgatggctgttggcatgagcttggatgaggcattggcattttgcaacgagtttagttcggcactcaaggtggctgctaacaactctccaacgagttgcacgctggcgggagacgccgatgctatcgatgaggccaaggcactgctggaccagagcaacacttttgcccgcgtgctggcggtcgacacagcatatcattctcaccacatgcggccatgcgcctcaccctatctcgaatcgctacgcagttgtgggatcagcgttctgaagggtcgcaaaaaatgcgtgtggtactcgagtgtttggggtgcaaatggccgcagtcgctccttcgacgaccatcatggtcttgagttgctcgggggacagtactgggtcgataatctgaccagtacggtgcagttctcccaggcagtaagcagagcagtgtctgaagaatcctacgtcttggatctcgcccttgaaattggaccgcacccggctctcaggggtccagcctccgaggtgatcaagtcgttgacgggtgtagctgttccgtattctggtgtccttaaacgcggagagggtgctgttgaggcctttgccgctggtttaggactcatctggtcgttgttcccgtcgatgcgccctatcatcacctttgacggcttacaccgagccttcccccaagccagcccaaagtatcctgtaattctcaaggacctgccgccttacccctgggatcatgatagcctcatctggcgtgagtccagagcatcttgcatcttccgcactcagagccagcctcgcgaactcctcggctttccggtcacactcggtgagcatggccggcgcgaggttcattggcgacaggtcttcaaactaagtgaactgcaatgggtgaagggccatgccatccagggcgaagttcttttcccggcaacggggtacctgaccatggcgtatgaggctgctgtgcgtctcgtcaatgaccatcaggcactgcgtcttgtcgagctgcatgacattgagatggtgcgtgccatgagcttgcaggaagattccccgggtcttgaggttctctttaccatacgtgttacgagccagtccgacagctgcattgccgccgaggtggcctgctacagcggcgatatcaacgtgacgaaactggacggccctttgacagggcttacagcccatttcagcggcagcgtgcggatttggcttggcctgcccctgaaaaacgccctgcctccccggacggagcctctgctgcccatgaacacgttggacctggagcagttctactggtatttgtccaaagtgggctacaactactcagatgctttcagagccagctcagtggaccgccgccttaaccaggccgtggtaaccgtcccggctccccctgagccgactacaattcggtcttctatgcaccccacggtcctcgacactgccatccaaggcctcttggccgggttttcatatccagaagacggtcgtctcaggacggtgtatctgccaaccgccattgactgcatccgtatcaacatggtggcaccacctgcgtctcccggcgtcctcatggcagatagctttctgaccttggcggatgcaaagtcacttgaaggcgacgtagatgttttcgactcaaaagatgccaccatccatgtccaactgcgcggagtccactggaccgccctgaaccaggaggaagatcgctggctctatgcagccgagacatgggtgcgagatgcggcttacgggattgagcccaggctcaagaccaaactctctccagagaatagtttgttacgcacgcttcttgtgcgaaccgcttacttctacctgcggagtcttcgagaccagatcaaaccctctgagcttttacttatgagcaaacatcggcggcacatgatgaagtgggtcagggagcatctatttccccagatcgaagccggcaagcaccccgatattcaagcagagtggtccaacgacactctcgaggacgtggagcaatggagcgccagctatttggcttcaggaaacaatgatatgcagctactacatgccgtgggtggtaagctgccagccatagctcgcggaactattcctcctctccaggtactgatgaaggacggtatgctcgaccgtttgtatgtggagggagtcgggtttgctgacggcaacctcgatctcgagtccttggttaagcagcttgcacatcggtaccctcgtatgaaggtgctcgaagtcggtgctgggacgggtggtactactcgagcggtgctttcggctttggacggcaaatacacatcatatacgtacacggatatctcggccggcttctttgagcctgcgaaagcaaagttcagccagcatctgagtcagctgtcgttcaagatgctcaacatcgaaaaggacccggtagagcaaggattcgaggagggctcgttcgatatggtcgttgcctcgaactgcctccacgcaacacggagcctgaaggataccgtccgccactgtcgccgcttacttcgacctggggggtacttggtgctgctggagatcacacgcgaccatcttccaatccagctcatcatgggtacgcttcctgggtggttcctgggcgccgatgagggacgagtctgggctcccacgatcggcctcgacgagtgggatgctttactgaaggtcaccgggttttcaggggtggacacaagctcgacgccttccttctgttcggtcatcttatcccaggcaaccgacgaaaccatccagatgctccgtcagcccctttccaccaattctcagtcgccaatgccgcctctcgaccaacaagtcctggtcgtcggcggttctgaactcgcatccaggtcgcaaacactcctcgcttctgccggggctgtcatcagacgtaaccttgagggcattgagattcccagcggtgccgttgtgctctgcctttgtgacctggacagcccggtctttaactccatgagccagtcgaggttcgaagccgtgcaggccgtcttccgaaacgccagtactgttctatgggtgagttcaggggcgacttctggcaagaatcccctggccaacgtgaccgtgggattgggacggactcttctggccgaacgtagtgacctgaggcttcagttcctcgacgtcgatgcgcccgcaacccttgaaccgtctttactagcaactcttctcctccgacttaccgggatgaattcagactacaattcggacgagatcctctggacccctgagccccagcttacactaagggacggtgctatatatatacccagggttctggctctggatgctatcaatcttcggtccacggcgaggcaccgacaagtcacccagctgaccagctttgagcttccagatatagtcatcgaggtcacgaagcgacacggagcactcgaactgctgtatcgccatcaccatgagcatgtccacaatgttaagccaggcgaggtgcgtgtgaaggtcacggcatcgtctctttactcccttgtctgctgcgaaggttcgtccaagatgtctgcatctgcatcttcgaggcctgctcatctgtgggtgggccacgacatggtatcaggggataaactcgtcggcctttcacacgcaagcagctccatcgtcacggttgctgaggattgcgtcttgtatcgccaacgcagtgccgccaacaccgccgccgaggagtcggtcgacgccgcgcaacagctccaccatttcacagctcaggcgctagtgaagcatctccttcgcgacttggagggccccgtctggattcacggcgccccaaatcatctcagcaaggcaatttcccgtgttgctgcagagcagtgtctcaccgtgttcgagacgacgtcggatatggagagagctggcgactggggtttcatccatccctacatcagcaagcgaaatcttcaatcactacgcatgcgcatgagagacgtgaaaacgttcatcgacttgaagccctggaagagcaacagtatttcggcgctgctgcgtgcctcgtctccacgttccaggctcgttaccatcgacatcgaagatctgaatgatctgattattggattgagccgcgaggacctatgcaggctggccagacagcactttgaagaccatgacaacatccggaggggcccggataacctagaccagatcctgcccatcgaaaacgtaacaacggaggtagtcaaggggttgggccctgcaacggtgattgactggtccgctaccgacaaagtcaccaccgtggtccatcctgtcgagcacaacgggctctttgccgctaacaagacatatcttctcttcggcatgacgggagatgtaggcatttcaattgctctatggatggtggatcacggagctcggagcgtcgtcctggccagccgtaagcccagtgtgccagccagtgtggttgagcatatgtcgcaaaagggggcagacctgcgtgtcatggccgttgacattacgaacagagatgctctgagaaccttttatgccgacatcaagtccagcatgccgccggtcggcggcgtcatcaatggtgcgatggtgcttcgggaccgtctctttgtcgacatgtcctggcccgactttgaggccgtgctggcgcccaaggttgtgggaactcagaatattgatgaactctttggcgacggtgaagaggatgagactctggacttcttcatcgtcctctcgtcggcgacttcgctggtcggcattatcggccaatccgcctacagtgctgcgaaccacttcgcggccagcctggtgcgccagcgtcgcagtcgtggcctggcgggttctgtcatcgtcattgggttcctgacggggctgggctacatcttccatcgttcagacaaggaacacctcgcgacgattgaaaagtcacttctgccacggctggatagacaatccgagacagatctgtgcgagatgctggccgaggccattgtgtgcggacgacccaactcagaccagccacccgagctaatcacaggtataaggacgtccttccaagaggcatggcaccaagacccgcggctttcgtgctatctcgtccaagaaggagttcgagagagcggcggtggaccagaggaggtcaacgggaacgttaaagtcgaggttcagctggcggcggtggaggatcccaaagacgggctgacagtcttggagaagtgcttttcccaggctttgggcaacatgctccagctcgacccagcgcaaatatcgggcgatgttcctgcagtcaaccttggagtcgactccctcgtctcggtccggattcgtgagtggttcctgaaggagctcggcgtcgacgtacccatcctgaaaattatgtccacgaaccacactgtatctcgactgtgtgaggacgctctgacaggctggcgaaggcttcaggcagggtccgatatggcggcggcaacatcctcttccggcacagctcgtcaggacccagagatggactggacaaaggaattgaccggacttattgacggaatccctgctcttatcccgcaaggagccgagtcggtcaaggatgcgcctcggagaagtgcacggcgcatcgttctcacagggtgcacaggcttcttgggtacgcacatgcttcgcaacctggtcgcagatgacaacgttgctgagctgcactgtctctgcattcgctcacgccgtgttcgcgtccgggaccccaggattcgagagtacaaaggcgacctgatgaagcccctgttggggctttctaacgacgacttcatccgcctcagccagactgccgacttgatcatccacttgggcgccgaggtcaaccatctcaagtcgtacgaggctgtacgcaccgccaatgttgtctcgacacaagttctcctcgccatggccacgccgcgcggtgtccccgtccatttcgtatcgtcatcatcggtcgccatgctgcagaaggggacccatgagctgcccgagatacccccgtcagccatctcccctccgaccgatgccgagtccctgatgaagaatgccataggctacgctgccagtaagtggatgggcgagatgctgctagaacacgccgcgccgcctgcggttgtgcaccgcttccccaacatcatggggcccgatgctcccgatgagatcccgctagttgcgctggaccgcttctgcacccggatgcgagccgtgccggcgttggatccgcagcagtgggtaggacaactggatatcatcgaggtcagtgatgtcgtgcccgagtttttggcaaacgcatatgggcacgatccccagaagggttttgccgtgcacaactattgcagcagtaacgagtactggctgtcggacctggcgggcatgtatgagaaaaagctcggcggccacattaaagtcttgccgacggccgagtggatgcggagagcgacggccatggggatgccgaagggagtagtggcgacgtttactggccatgacgaagtcttcgtatcgccagtattgcggaaggggtcaggttcgaggtaa

SEQ ID NO: 349 - DNA, 1689 bp, Scedosporium apiospermum
atgtctccatcaacggcttcccacgatctcaagtccaaaaaggacaagttggatgttgagtttaacgaacaatccacggcgacatcttcgactgtcgaggtagagaccgagaagaagcgagatactggtaccgatgaagaagttgccgttgcagaatctgtgccgcaggattccggcgactacccatcaggtctcaagctcacattcatcgtggttgcgcttgtactcagtgtctttctcttttctctggatcagaccatcgttgcaaccgccattccaaggattactgacgagttcaaaagcatcgacgacatctcgtggtatggttcgtccttcttcatgacacttgggggattccaatctatgtgggggaaagtgtacaaatatttcccccttaagatcagcttcctgatggccattttcatctttgaacttgggagcttgatctgcggtgtcgctccaaactctcccgccctgattgttgggcgtgctattgctggcgttggcgccgcgggcgtcgggtccggagcgtacacaattattgctttcgctgctgagcccaagaagagagccaccttaaccggggttattggcgcctcatatggcctcgccgctgttactgggccactcattggcggagcgtttacgaatacggtctcctggcggtggtgtttctatatcaatctcccgatcggtggtctcgccgcttccatcatcttactttccttcaaagctcctccggcggcgaaaccggctgaggctacgctccgggagaagtttctgcaaatggaccccctggggaccgcgctcattatgggcgccgtcatatccttcctcgttggtcttcattacgctggtttagggaagccgtggaattccagcaccgtcatcggcttactcgtcggctgtggtctcatggccattgcctttgggtttctcgagtccgtccaaggcgaacgcgcgatgttgacaccgcgtcttatgcgcatgagaaacgtctgggtcaacggcatatacggggccttcttcgctggttcgtacttcgttccgttgtactatctacccatttacttccagagcatcgacaacgcgacgcccattggctcaggtgtgcgcaatttgccgctcatcattgcctttacaattgccaccattggctcgggtggaagcatctcgaagacgggcattgcaacccccatactgccagtcggctctgctatcgccaccatcgcggccggtcttctctatactctcgacatcgggactggggcaggcaaatggattggctaccagattcttgccggctttggatacggcctgtcgttccaagtcccgatcatcgtgagccagggaactgctgaccctagcgacttggcttctgtgacagctattatcctattcttccaaaccatcggcggtgcagctctgattggggccgcgcaatccggcttcgtcaaccagctcttgaacaagcttcccagcaccgcgccgggcgtcaatcccgctctagtcgtggccgctggcgccactgagctgcgcgaggtattttcggcagacgatctggatggtatccttgttgcgtacatggcaggtatcaaggttgcttttgcaattactatcggggccgtgggcttctcgttcccaataagcttgcttagcaagtggaagagaatctcaacagcagcttag

SEQ ID NO: 350 - DNA, 1329 bp, Scedosporium apiospermum
atgggcatcgagctgaaacaacccgactctgcgcatctgccgcacacaaacggctcatctggcacactgcctgagagatcatcaccaactggaatcgctgttttgattgttggcggaggagtagccggcttactggccggtctcgagtgctggcgtcagggccacgagcggtggccagacatggccaaggagaacgaccgcatttcatacgagatgtggatttcatggcataaaatcaatggggacctgatttccggtccggctcctttccgtcccaatgctcaaaagaaagatggccctgaaggtccaaatactctgcaaaccgccaagatatatagacacagtcgtccgaccatgcacaagatgctcgccgatcaggttgagagagttggactcacggtggaatacggcaaacacgttactcaataccaagaggaccctgattcttccaaggcttatgtgattttggaaaataacgaaaagatcgaggcggacttggttgtcgcagctgacggaattggcagcaagtcttatagtatcactttgggccgtcaagtcccggcccgccccacagggttttcaatctatcgagcgttgctgcctatcgatcaggctcttgtagatcccgttatcgatgagaagttccctctgttagagaatgggatgtcctccacccaactctggatgggcattgagtcctggtctaacaaggttggacccgaggtcgtgcttcaaaccacggccacgattgacggttggcccgacttcgcggatcgattgatcaaggcaacagccaaggatcagatccacgacttcaaactcatgtggcgtgagcctcaaccttgctgggtttccccaggcggccgagttgtgcagatcggtgatgcggcgcacagttttcttccatcctccgggaacggtgccacgcagggtatggaagacgccgtctctctggcagcttgcttgcgacttgctgggaaagacaatgtgccctgggcaacccgtgttcataacaaactgaggtttgagcgggtatcctgtctgcaaatgctgggcgtcctcaaccatgagatgcgcaatcgctctgccaatgcggatgcttcacagacgaagcccatcggcatacttggcagctggatttggaaacacgatccagagcattatgcaatcgaaaactacgagaaggcgttaaggcacctgacgagtgggagtgaatttctcaatactaatgtccctcctggacatgtataccagccgtggaccattgatgaaatcctgaaggccaaggaaacaggcagggagattgtcttggatggggactgggattaa

SEQ ID NO: 351 - DNA, 1167 bp, Metarhizium anisopliae
atgttttcaagtctcttgttgctcaacctattgcctctggccatcgcggctccagccaagcgagctgagccggcaccactccttgtcccacgaggtgacactatccccgacaagtatattgtcaagtacaaagagacctttgatatgtcagctgccgacatcaccatcaaggaataccatgccaaggcggagaaaacgtactctcacgtcttcaacggattcgctggcgcgttgaacgcgacgtccattgagacgcttcgtaatcatcctgctgttgattttattgaaaacgatgccactgtcaagattagcgcatttgtcgaacagccgggtgccccttggggtctgtctcgcatttcgcaccgacagcgcggagcaagtagctacgcctatgatgacagtgccggtgaaggcacatgcgcgtatgttatcgatactggagtcgaggcttcgcatccgaaattcgaaggtcgagccgagtttactaggtcctttgttgccggagagacctctgatcgcaacggtcatggcacccacgtggccggaaccattggcagtaaagactttggcgtggctaagaaaaccaaaatccgtggaatcaaggttctgagtgaccaaggcagcggcgattactccggcattcttgccggtatggactttgctatccaagactctcgagaacgaccctgccccaagggcgtcgtcgccaacatgagcttgggaggcggctattcagctgccatcaatcaggctgctgcaaagatgatccagtctggtgtattccttgctgttgcggcaggaaacgacgcgaaggatgcctcccaaacgtcccctgcctctgagcctagtgtatgcactgtaggagcaacggattcttctgatagactttcctccttttcaaacttcgggcctgctgttgacattcttgcccctggaagcgatatcctgtcaacttggataggtggcgctactaaatctatctctggtacttccatggccacgccacatattgttggtcttggtgcctacttggcttctttggaaggcttccccggtgcacaggctctttgcgaaagaattcgctccctggctacaaaaaatactattagcggtgtcccaggaggaactgtcaatttgcttgctttcaacgggaatccatctggataa

SEQ ID NO: 352 - DNA, 378 bp, Metarhizium anisopliae
atgctcggctttgccaaaacccttcttcttgctacccagctggcatattttgccagtgcgtcgcccaccctcaacaataacaataagcttacgagcaaatggcccgtgtgtatccctcccccaacacaagtctcaaccaagcgaacgccgactgagaagcgagacgccagcgttacgactccgttgcccacccagccaggcatggttggcaactgcaacaagttctgctggatagagaatggcgacatctgcgggcagattgctgagagcaatgacatttccactaagcaattcatccaatggaacaaaggcgctggtccggattgcctcactctctgggcgaaaacatatggttgcgtgggcgttacggactcgtaa

SEQ ID NO: 353 - DNA, 7575 bp, Metarhizium anisopliae
atgggttctttagctgctaccgtcgggaatggggaaaccaacgaatcatcccttcaacaccctgcaactcatggtagccataccaacaacggccatacgatcaatggccatacaaccaacggtcatagcctcaatggccatttcataaacggccacaccgcaaacgataacggtactatcaatggctcgctaaacgggctcggctacccgggtcaaactcccatggccatctgtggcatggcttgccgcctcccaggaggaatagcatcggctgaggagttatgggaattccttttggcaaaaaagaatgcccggactcgtgtgcctgaatcccgctacaacgtctccgccttccactcccccgtttccaaaccaggaacggtggctacagaatacgggcattttcttgatgatagcgtcgaccttggggcactggacacatctgtcttccccttgaatcgcactgagctagaaagatcggacccgcaacagcggctgatgttggaggttgccagagaggcctttgaagatgccggggtgaccgactggagggggaagacggtgggatgctacatcggaaactatggagaggactggtctgagatgtttgccaaggaaccgcagcaatacggcttgcatcgaatcactggtactggggactttgtcatcgcgaatcggctatcatacgaattcgatatcaggggtcccagcgtcacaatccgtacggcttgttcttctgccctcatcggcatcaacgaggcctgcgcggccatcgcccgtggagattgcgaagccgccatcgtgggcggccttaatctgatcctggcgccggccatgaccatttctgaaacagagcaaggcgttttatccaaggatggctcttgcaagaccttctctgcagatgctaacggctatgcccgtggagaagctgttactgctgtcttcattaaaccattgaccgacgcaattcgtgacggcaacccggtccgggctgtcatccgggccgtaacgaataactcggacggcaagacgcccgggatatcacatccaagcactagctcgcaggaaaccctcatgagaagagcgtacgccatggcaggaatcaccgactttggggaaacagctatggttgagtgccacggcaccggcacgcccatcggcgatcctattgaggccaatgccgtggctcgtgtttttggagagcggggagtttacattggttctgtcaagccaaatttaggccatacagagggcgcctcgggtctcgtgtccctgatcaagatggttaaagcccttgagcaccgcacaataccaccccagatccggttcacggctcccaatcccaacatcccctttaaggaggccaaactcacggttcccctggagccaactccctggcctcaagatcgcctcgagcgtgtaagtctgaactccttcggcgtgggtggctccaacgcccacattatcctcgagtctgccgccatgcacaacgccgcaaccgtcattcacgccacgccggaagaacctcaactccttttatacacggccagttctgccaagtccctcaccagggtgattgacaactaccggcactgggttgagaggaacccctccaaggtcgccgacctggcctacactctggctaggaagcgagatcatgggccgcacagggccttcgctattgccaacggcggcgcaattgaaaccgtctcgccgcccgcaagcatcaagcccggcacgaagccgcccaatatcgtcatggtctttacaggtcagggcgcgcagtggccccagatgggtcgacagctatggcagtccaacgagaccttcaaggccagcatccagcacctggatcagtgtctccaagccatttctggagaaaggccacactactcaatccaggaggagctcaagaagccggccaagaagagccgcgtatcttcggccgagatctcccagcccctgtgcacggcaattcagatcgccttggtcgactccctcaaggccctgggcatcgtgccgcgtgccgttgtcggccattccagcggcgagattgcggccgcctacgcctccggggcgctcacagcgagtgaagccatcgtggcagctcatcaccgtggcgccgtgacgaataggcagaagagaaaagggtccatggcggccattggaatgagttggcgagatacggagaagcacctcgtgcccaacgtcgtcattgcctgtgacaactctcccaaaagtgtgacaatttcgggtgacaccgacaaggtcaaggctgtggtggccgatattcaaatgacacgtccagaagtgttggctcggctgcttcaggtagacaaagcataccactcgtatcacatggctgagattggagacgactacgcctcgttgattagcggccaagtgactggaaagagtccttcgaatgccctcttcttctctagtgtgacgggaaagctgctggatggagagcacaatctcgggtcggcatattggcgggcaaacctcgaatcccccgtgcggttccgtgaggccgtcacaaacctcctgaatcgcgaggttggcaagcatgccatctttatcgagattggccctcactcggccctcgcgggaccgctaagacaaatattcgccgagacctcttcaccttgtccttacctgtcagtcatgatccgcaaccaggattgtcttggatcctatctggctgccgtcggcaaactccattcactcaatgtaaacatcaacctcgacgtcttgttccccacgggttcttgtctaccagatctcccaaggtacccgtggaaacacgagaacacctgctggtacgagtctcgtctgtccaaagattggcgcttccgaaagttcccctatcatgatctccttggcctccgagtcgtcgagagcaccgagctcgagccggcctggcgcaacctgtttcacctatccaacacgccttgggtccacgaccacaagatcggggacgatatcgttttcccctttgccggctacattgccatggctggcgaggcggtgaggcagacgacgggcatcaacgacgggttcagcattcaaaatgttcttgtcagcacagcactggtcctccccaagggcaggcccacggagatgatgaccacgttccggccaaagagcctcacaacgtccctgaacagctcctggtgggaattcaccatggcctcgtacaacggtgacatctggacaaaacactgcacgggcgaagtcatggcgctcatgtccgacccaagaccgggacaggatcccgaaccccttcctcgcaaggtgaacacggacaagtggtacagcaacatgagcaagggcggtcttgaccttggcccctgtttccaaacacttgccaccattgagacttcaacgagtccagaggacaacagggccattggaaatgttgtcaacggcaggcagggcgatgaggccaactaccacatccatcccaccgtgctcgacgcgaccatccagatcctaggtgccgccgccaccaacggccagatgcgcaagaccaagacttggcttcctaccagcatggacaggctcagcgtctaccgttgctcgtcggacatggtcaccagtgtcagcgcgaggctgtcaagcaaccattccgtagtgggaggaggccgttgcacggcgggcggcgtcgtcgtcgtcgaggctgagaatatcaaaatgtcacttgcggccaactccctttcaaatgaggtccccgacacacacgcggccgcaaggtacgagtggagcgccgatattgactttatgaatgttggcgagctcctcctcgcaccagcaggtcgctctgaatacttgcatctcctcgaggagctcgggcaactctgcttgctttcctcgaagcgccgactttactcgacgtctaagccggtggtcctcgctcctcatatgctcaactatgcgtcctggattacgtccgcttccaaggtggtcgtcgtcaacctagcgtctgtcatgagcaatcttgacaacgagaacatctcggcccgcatccacgctctctcgaaccgtcttgctgatactccaatgtcgccggtcgctaatgccatccgcgagatatggacgaagatggatctcttgctgtccggacagacgctggaagatattctcccggaggagacactgtctagtgtcttgcagttcgtgcacaaatccattgactatggcccatttattcggcatctggcacactccaaacccaacctgcgcatcctcgagattggcggcgacagaagctcatcggtagccagtggcattgccgaggacctcacacgccccgatggccaggtgctctgttccaagtataccttgagctcgccaggctttgtctccagcaaggaccagccgatgctgctccccaatatggaatacaccactctggatatcggccaagatcccgcggatcagggctttgagggacaccaatacgacctcatcatcgcatccaacgtcattggggccaccaggaacccgcagcagagcctggccaacatcaagagactcttgagtcctaacggccgactgcttatgcaggagacttgcccgtcgtccaaatgggccacctatgttttcggagtcctcccgacgtggtggcaaggcaccgctgacgggtctgacgaagcagccgtcctcagtcccgaaatatggcagtcgaagcttgcggcggcagggctcggcagcatcgaagcaacggttctggatgccgagcagcctcaccaactcactgcgaccatagtagcaagacatgacttgccccaggagactgcccctagacgagtcactgttcttgtcgaagacgagaatggagctgccacccggcggatgctcagccgactagaagatgacggttacgccgtgacaaggtgcaagttgaatggctctccgccagtcggacaggatgtcctctcctgcctggacctcgacaaacccttctttgagaatctcagcgagccacgatatcagctcctcaaagacttcctcctcggcctcggcggcgccggcgttctctggatcacggctctcagccagcggggatgccgtgatccccggtacgcccaagtcttgggtctcgctcgatgtgtccgctccgagatgattgccgactttgccacgtgcgaggtggacagcttcgacaatgcccagtcgatggacatgatcccccgggtcctggccaaattcgagaagcgcgacgacgacgccgacgacgccgtaaagtccgactttgaatgggccattatcgacggccaggtacaggttgggcgcttccacaaattcgtgctgcgagacgaactccttctgtcggaacccgctggaatggcctcccttgatatcgggacgcctggcctagtcaacagtctgcgttgggtgcaacagccgcgcgaggccgagctgaagccgggcgatgtagaggtccaggtgcactctgtaggcttgaactttcgggacatcctcgtggcccttggcatcgtggaacttccggtgcgccagtttggattcgaagcagcaggcatcattacacgggtcggaaaggacgtggaccccaaccagctcaaggtcggcgatcgcatctgctgcttgaagaagcaggcctttgggacttatattgtcactccggactatagttgtactcatgtccccgacaacatcacatttgatgaggccgcgtccatgatcatgccatatattacggctatccacggcttgttcactactgcacatctttcaaagggtcagaccgtcttgattcacagcgcatgcggtggcgttggtctggccgctgtgcaaatttcccaaatggtcggcgctgaagtttactgttccgtcggcagagaagacaaggtcgagttcctgatgaacaacttcaacatcccgcggaatcgcattttctactcccgtgacaagtcctttgttggtgacgttatgcgtgagactggtggccaaggcatggacgtcatcctcaactccctttccggcgagctcttgcacgcaacgtggacatgcgtcgccgagtttggcaccttggttgaaattggaaagcgagatctgatcggccgtgggaaactcgacatggagccctttttgaagaaccgcagctactgctgtattgacattgaccgcgtctggtcgaagccgtggattctgagaaaacacatgctggacgccttcgactggtgtgccaagggtcttgtcacccccgttcgacccgtcaaatctttcccagccagtcaaacccaggacgcgttccggtacatgcaaaaggggtttcacattggacgaattggcatttccatctctcacaacccagaacacccggatacccagtttgagactgtcaagatggcccgacccatcacatttgacagatccggttcctaccttcttgttggggggctcgggggtctcggccgcgccatttccgtctggatggccgagcacggcgcccgcgaattgatctacctatcacgaagcgctggaggggacaccaagcacgacgtcttcgtggccgagctcaagagtatgggctgcaacgtcaagctcatccagggagacgtgaccaagctcgaggacgtcgagaaggctgtcaaggcggcgacacatgcccttcgaggcattatccaaatgtccatggtgctgcgtgaccaaaactttaccaaaatgacctttgaggagtggacgggtgcgacagcccccaaggtcgagggcacatggaacctacaccgtgcctccctgtccgctggtacagacctggacttttttgtgctcttcagctccgtttcgggaatcatcggccaaccaggccaggccaactatgccagcgccaacacctttcttgatgcgtttgcccagtaccgcaagggcttgggcctggcagcctcggtcgtcgacgtcggggccgttgaagacattggcgtcattaccgagcgccaaggattaatgaacaccatgaaagcaaccggcttcaagggcgtcacagagcaggaactcttggacgccatggtcttggcaatgtttgcccatgctcggccgacggggcagggaaatagtccaggcttccactcggcctttgtcgaggccaacacgtttgtcctcggcctggactcgtcgataccgctgagtagtcccaacaaccgcgccgtgtggaaaagagaccgtcgcatggcggcgtaccacaacgccgctgccaccggtgctgaagctgccgcgtccaacgatggtctcaagtcgttcctggctggtgccagggccgaccctgctgtcctcagctcgccggagacggctaacctgttcgccgttgagattggcaagaaactctttcacctgctgctcaagccacaggaggacctcaacatagccttgcccttggtcgacctgggtctcgactcgctcgtggcactcgagctcaaggcctggtggaagcaggtcttctcctttgacatcagtgtgctggagatgcttgcgatgggatcccttgcggcgcttgggaaacatgccgccgatcagatgatcaagattaccgccattgataaggacgcgtcctga

SEQ ID NO: 354 - DNA, 1683 bp, Metarhizium anisopliae
atggatcaacaaccagaaccggaccacggacaaaatatcaggcgaaggcgtagtcggcagtcgtctgcggcgccgtccgtccagctagaagcgaatgcagctcctgctttacctcaacgggcaggacggccgctttccttttggctcgccttttccggtctctgtatcaacacgtttctcttcgctctcgactcgtccactctctccgtggctcttccagccattgcgcacgagttgcatggcacaactttcgagtcgttctgggccggaatcgcgtaccttctttgcgtggtcatcacccagccattgtacacctcactgtccgacgtcttcggtcgcaagcctctgctctatgccgctctcctgctctttgccatcggctcgctagtctttggtcttgccaagaacatgacgtatatcattgtcggccgagcgtttcagggctttgggggcggggggatggatctgctaagcgagatcatcataacggatataacgacgctgcaggagcgtgccatgtttctcgggctgctggctattcccatcgccattgggaccatcatcggtccaactatcggcgccgtcttcagcgaattcatctcttggcgatggatcggctacgcaaacttgccctttgtcggagtctcgttccccatcacattctttttccttcgtctccgtacggtcaacgactccctcatggacgatgtgaagaggctggattgggggggcatggctctctccttcaccggaatgattcttttcgtgctacctcttagttggggcggcgccttgtactcgtgggcctcatggcagacacttgtcccgttgattatgggaatccttattctggttggttactttgcctacgagtcactacccgccgctccgatcatgccctatcgattgctacgatctacaacagccaaggcgacactgctggggaactttatgcaaggcttcgttctcttcccgctgcaacagtacttgttgctcttgttccaggcagtctacctactgagccaaatcgacacggctgtggagctgctccctaccagcatcacatgcgtcttggccgccagtggtgtggtcatcaccataggtctcctcaaatctggatatctatggagtatcagactgttctgggttgtcctcacagtgggcaccggccttgtcgccctgttagatgaaggctccccccgtgctatgcgaatggccatccccatcatctggggcgcgggtataggcgcattgttgcgtctcctccaccttccaatgcaagcaagtgtcgaaaacgtggatgacacggggctggccgtcgggctcgtcctttggtttcgcctggtgggaggcctcctcggactcgccgtctcatcctcaatatttatcagtgtctttgccaagtccattgccggcgttgacaacctccccgagtctcttgctcccctgagagaagcgagccgggccattagctttataccaacgctgagggatctgggtctttcccgggacgtgttgggcctagtcttgggagcttaccacaaagctttccagacagtattttacgcaatgactgcctttggcggtgttggtttcgtaagctcactatttaccaaggagctcactctgcagaaaagcgaccttggccggcaggcgtttgagggacagcaattattaccctaa

SEQ ID NO: 355 - DNA, 978 bp, Metarhizium anisopliae
atgtggcgcatcccaacggacacccctcaaacttccactcccaacggacgcaccaagctccaggaagtcaccccagaaacccccttggacgaaatcttccaaaagtggggagaagatggcgcccttgtcatcaaaggcctcctcacccctggtcaagtagccgaattcacctctgaaatcgaacaagtcattgaaaaaactcggcgtggcgctctgctggaccacccgctccttcaagcctttcacggccgccgaacgaagcgcgccgccggtctcgccaaccatagcaaggtgtttcgcgagaaccttctcgagaacgacctagttcatgccatatgccaccgcaactacactacgggaggcaacgccggcgattactggctgtccacggggtcaactttgtttgccggcggtccgcaggacccgcaggagctgcatcgagacttgaacaactaccctcctgccgtcttgcttggcccagactttgacgatgtgcaaatgaactttctgattgccctcagcccgttcagggaggacaacggcgcgacccgggtcatcccagggagtcagaagtggccctttgaccagcgcggcaaccaggaaatgacgatcccggccatcatggacccgggcgactgcctccttttgagtggcaaggtcgtgcacggcatgggtgcgaatacaaccacggaggagcgaaaggcattgcagctgtctgtttgcgcaggctatctgacgccatccgaggcgcatccgagcattgtcaccctagagactgccaagaagctgtctccaagggcgcagcgatttttgggtttccggtcccagtaccctagggggtcacctggattgtggaccaaggattacactgagctggctttgcatttggaactggatgatcttgatggcctgatggtttatcttcgtgaccttgcgaaaagtcatccagttgaagacccggttggcaaattgttttag

SEQ ID NO: 356 - DNA, 1131 bp, Metarhizium anisopliae
atggccaaatcctatcatttgtccttggatattgctaaaggcatccctaagactctccttctcaaccgacaaccctcaatctctcacctgagagcaaaagaaggacgtgtggatcactcgatgatgaagcgacccgaggattttcgcggaaaggcaagttttctgctctgcggggataccgtctttgttaccggggggtctgggggattgggcaaagccatatcccagcagttagcagcccgaggggcccatatcacaattttctcccgcaggccagacgcacttgccagggccagagaggagatactttccaagtgtttgactggggatcaggaggtcaataccgtcgccatcgacatggcggatgcttcaaaggttgacgaagcatttagaaaacagcctcggattgctgacgtcttgtactgtgttgccggcggtaaccatgctgagaacggatttctcgtagatattaaggcacaggctcttgaaagttgcatgcggaacaactactttaccgccgtgtacgcagccaagtctctgctcgacatatggacagaggatgatttgaaaggacccattcatccccgccctgaccccaggatacgtcagattgtctttgtcacaagcgccgccgcgtttttgggttctccgggctccatttcttacactccggccaagtgtgcaacccgcgcctttgcggatactctgcggttggaagtgctgcggtactgctgccccgagtcgacctactcgatccactgcgcctttccaggggactttgtatcccctggatttgtcttcgaacagaagaccaagacgaatctcacaaagcgcattcagggtctcgacggctacaccatgtcggagctcgaagctcggttcccatcttcggacaagatcgcttcactcatcacttccgccgtggacaggggcgatttcatcatctgtgacggctcgctggctggctcattgctcttcaccaacatgattgggccgtcaccaaagaggggattgggcattgtggattctttgctttctgtatttaccgggtgtcttctctggccatatctcaggtggaaatgggagtccatgacccgcaaggacggcgaagagcacagaagagctaggtga

SEQ ID NO: 357 - DNA, 1401 bp, Metarhizium anisopliae
atggatttcctggcggattttatcaaggctcagaagatcaaggggccccagatgaaagatgccccaaccttctaccgcaacctcgaggaggctttggacctccggcgatccgatcatggcatgttcaccaacggtatgaagagtccctggaagtcaggcaaggccgtcgacttttgctccaacgatcttctgtccctgggaaagacgggactgcttcgcaaggagttcctcaacgagctgggccgtaactccgacttccccatctatgcaggaggttcgcgcctggtggacgggaactacgattacattgaacaagttgagcaggaaattgccgccttccacggcgctgagatgtcactcattgtcggctccggtttcgaggctaacaatgccatctactcggcaatcccacgccccggcgacgccatagtctacgacgagctcgtccacgccagcgtccatgacggcatgacgcactcgctggccttgaccaaggttgccttccgccataatgatgtcgacgccttgagagatgcgctagtagaacttgtcgactcacagcccttgatcaaggacggctcgcgcacggttcttatatccgtcgagtccgtgtacagcatggatggtgacgtttgccctctacgcgagatgcttgagatttcccgcgaagtgtgccccaagatgaattttgcttttattgtcgacgaagcccatgctacggggataattggccccaagggcgtaggacttgtcagtctcttaggtctcgagaaggagattgctattcgactccatacatatggaaaggctttggcctcgacaggagccgccattttgagcaacggaacggttcgaacggctctgctcaattttgcccgctccgtcatctacaccactggcccttcctttccttcggttgcatgtattcgagcagcctacaacttgatgcgcaacggagaaacgacaaagttacaaaacagcatccagcatctcgtgaagcactttttcgaaaccatcacgtcgaaccctgtgtgggaaaaagccagcgagatggggattctggccatccctctggtcgacgattgggaaggacgcgagttccagacgcacattgtacccctctggacacggcagcggtataactggtggctcgtattccatctgcagttggcgggaattgcggccgtccccattgactaccccacggttccaaagggccagagcaggattcggatcatggttcatagcgccaacacggaggccgaggtcgattttcttgccagcaccatatgtgaatgggcacaagagatgattggcattgaggagtcgggggaggtcaagggaaagacgcccaaagccgctcagaaaatctacgccttgatggctgctgctagcgcttga

SEQ ID NO: 358 - DNA, 1653 bp, Colletotrichum orbiculare
atgtccaccacccagcttcccgtctccgacgtcgacagatacgactatgtcgtcgtcggcggtggtactgctggctgcgttatcgcctctcgcctggccgaggctctgcctcagaagcgcatcctcttgattgaggctggtcccagcgacttcatggacgaccgtgtgctcgacctgcgcaagtggctcgaccttctcggcggcgagctcgactacgactaccccaccaccgaacagcccatgggcaactctcacattcgccactcgcgcgccaaggtcctgggtggctgctcgtcccacaacaccctcatctccttcagacccttcgagtacgacctgaagatctggcagtccatgggtgcccacggctggaacttccacgatttcatgcgcgtcatggacaagctgcgcaacaccgtccagcccgtccacgcccgccaccgcaacgagctctgcctcgactgggtcaactcttgcagctccgccctcgacgtccccatcctccacaacttcaataagcacatcacccaggacggtgccctgaagcagggcgtcggtttcttctccatctcgtacaaccccgacgacggccgccgctcctccgcctccgtcgcctacatccaccccttcctccgtggcgacgagaagcgccccaacctgaccgtcctcaccaacgcttgggtctccaagctcaacctcaagggcgacactgtcaccggtgtcaacctgaccctcaacgacggctccaagcgcaccatcaccgccaagaaggagaccatcctcactgccggcgccgtcgacactccccgcctcctgctcctgtctggtatcggccccaagcagcagctcaacgacctcggcatccccgtcatccacgacctccccggtgttggtgagaacctccaggaccaccccgagtccatcatcatgtgggagctcaagcgccccgtcccccccaaccagaccaccatggattccgacgctggtatcttcctccgccgcgaggcccccaacgccgccgccaagaagactttcttcaaccccgacggtatccccgacggagatattgccgacgtcatgatgcactgctaccagattcccttcaccctcaacacgggccgtctcggatacgacgagcccaaggacggctacgccttctgcatgacccccaacatcccccgccctcgctcccgcggtcgtctctacctcacctctgccgaccccaatgtcaagcctgcccttgacttccgctacttcaccgacgaggagggttacgatgccgccaccctcgtctacggcatgaaggctgcccgcaaggttgcggagcaggctcccttcaaggactggatcgcccgtgaggtcgctcccggccccaaggttcagaccgacgaggagctctccctctacgcccgtcgcgccgcccacaccgtctaccacccctgcggaaccaccaagatgggcaacgtccgcaaggaccctctcgccgtcgtcgacgagcgtctcaacatcaagggcctgaagcgggtccgtatctgcgacgccggcatcttccccaccatccccaccatcaaccccatgcttaccgtgctcggttgcgccgagaaggccgccgagttcatcatcgaggaggcccaggagactgcccgtctctaa

SEQ ID NO: 359 - DNA, 2115 bp, Colletotrichum orbiculare
atgcagcaatcgtcagaggcccagcggtccgtttcaaaggcccagttatcttgcactacatgtaggacgcgcaaggtcaaatgtgatcataagaaaccagtgtgttctgggtgtgaaaaatatggagttgactgcgtgtggcccgagaggcggaagaacacaacgcgtaaggaaaagaggctgtatgagaatatcgtcgccaggctggcgcagatggaaagctttgtaaaagaacttcaggaggcgccggcgaacgtgtcaccgcctggtcccaaaactccggatagcccaccgtcgccaacgcagaaggagtcccggacgagtcctcagagtgcgaggaggacttcatcggctactggagcgtctcaaatctcaccacagctgccgccatcaccggccacaagctctccgagagcctcgaagctctactacaccggagcagcctctgaagcaaccattgggacgtcgggccaatgctcgctattttcgctcgagggcatcgcaaagattgataccctcgtgggagaccggcgcttctcggactgcgttcgaaacctgctgcaaaacatcaggactttggcaccgcagcgaagcattgactttgcggcttcgcagcgggactacccttttccttccaacgatgtcatcatatttgccatgaacgacttcttctcgacccttaatcgaggtatcagactgcttgaagaagctgaagtgagagctgccgtgcaggcctacatgtacggtcagccattgaatcagccgggatggaaactggccctcaacgtcatcctcgcccattctctccgcaagcgagactggcactcccagtcccgcgagtacgagagatatctctacaacgccctgtcgctcatccccaacgccatcttgcagacacccaaccccatgaccatcggggctctcctatctctggcctcctggttcgtcttctcggccgagaaccacatcgccgtccccatcctcgccgtcgccacccagctcatcctcctcgcgggctaccacaacccagaccacccgcactgcctcaagccctccgagcaggacaccctccaccgccgccggctcttctggcaggcctacgccatggaccacgacctcatgctgcgcatcggcaaaccgcccctcatcagcgacgacttcctcctcgacctgcccgaggagttcccccacgacggctacggcgtctactacttcccggacaacgtcgccctcagcttcttccaccagcaggtccgcctcgcccagatccagggccagatcttctccaagctctacttcaaaaccgacgccgccatatcctcggcctccctcgagtccgagattgccgccctcgacgccgagctgcaggactggcgcgagggcatccccgagatgatccgccccgaaccgggcggcgcccgcctccccgacgacgacttcaaccgcaccatggccctgagcgtgctgcacttcatgtacttccagctcgtcgtcgccgtccactccgccgcattccgcctgcccctcctcgacgacgacaccgaggccctgcgccccagcgccgcgctctgcgtcaacgccgcgcgcgccgccattgccctcctccggcgccagaacctctcccacccgtttacaacatacgtcctctaccaagtctcatggagcgtcgacatcctcttcgtcaacatcctcgagcacaggtccgccccgcagtccgcgcaggacctcgagctcatcaggacggtgctcgccttcttcgagcgctacgacgccaaccaccagcgcgtgccctcgtaccacatcatcaaggccctctgcgaggtcgcatcctccgtcgttctcggcgcccgggccgtcaccccggaacccgcgccgccctctacttttcagcggcagcccgccgtcgcagaacccggggtgggtgggtttgcggcgccgtctattgtgccgctgccggggttgaatatcgacatcgactggggcagcgtgtcgctgggcgggcatgactggttgtcggccgggtttctgcagatgacggattggggggtgcaggcgggggctggtgggatggagtttcaggtagatccggatccgacgggagggagtcacgggtga

SEQ ID NO: 360 - DNA, 1635 bp, Colletotrichum orbiculare
atgctcgccctcaagttaacgccgctcctggctctcgcgcccttggccagggccgacctcaaaatcacccaaccggacggcagcaagccggtcgacctctccgccgagtctatccccatcaagtgggaagaggacgcgacgacgcggggccccaactctacccgtatcaacgacaacacgcaggtggacctgtggttctcggccacggtgtccaagaccgggaattacttggcggcgctcttggcggaaaacatcaccatccgggatgccgacgggttcgactgggaccccgaaaacgccaccgactggttgagcgtgaacgacgagggcttgaccgacgacaaaatctttagcatatacgcactcgtccaccaaccgggcgcgaacggcaacaccccggtggagagctccaagtttgcggtagaggggtttgagttccaggaggacgcgaccgttggcagtgttggaagcgcgttgaagccggctgtgggtttggttgttgccagtcttgcggctgcttgcaatgcggagaaggcttccacagccggtacaggcactgcttcaatccgaagtctgttgctcaaacgacttgtcaccatggggaatacaatctcaacattcttcccgccagcacccacgttcgcagaagacgaaatcccgagccagaaggggcgcgtcttcatcgtcactggcgggtactctggcgtcgggtacgaactcagtcgcatcctctggcgacacggcggaacggtctacattgctggaagagatgaaagcaaagcccagcaggcgatatccgatctcgaacaacaaaagacgacagactctgtcgatggcggacttcggttcctcaaagtagctctggacgacttcaacagcatcaaggccgcagcggaaaagttcctcgcagaggaaaagcgcctagatgtcctcttcaacaacgccggcgtatcgaacccgcctgctggaacggtatcggcgcagggccacgaagtgcagttggcgacgaactgtctggctccttactttctcaccaggcttttcagtccgttgctcatctcgacggcgaagctgacggatgcccctggagcgacacgcgtagtctttacgacctccatcgccacgcagctaggcgccccacgtggtggaatcaacatgaaggatgtgctcgtcccgtcaaaggaccagcaagtcaactacgcaacctcgaaaaccggcaactggttcctcgcggaccatttcgcaaaggaactcggtcctcacggagtggtcagcgtggtgctgaacccggggaacctcaagacgccgttgttgcgacacatgtcctgggttgtccctattgttgttgcgccgctgttatatcacccgagattcggcgcgtacacaaacttgtttgccgggttgtctccggatgtcacggtagaagacggcggcagatggattgagccctggggccggtttcatccgaatcctcgggaggatatcattgaggcaatgaaggatcgtcaatatggcgggctgggacttaaggcggccttggttgaacattgcgagaagttcacgcgcctcggccacgtctcgttgcactgcagatccagtcagggccagttgtgccaggaagccagacggaggtaa

SEQ ID NO: 361 - DNA, 837 bp, Colletotrichum orbiculare
atgaccatgctcaaattcggcccggttcctggcgagagatctccatgtcggcatctgcattggcgagaaggctccctgaacaacagtgtagaggggcatttcggtgagaagccggtactcaccaccgatggaatcaaattgcccagatccttcaacgcatggagcttggaaacgataagcggcatcggcatttcattcacggacaacctagccgaccatcttctactggtggaagacgagaagggcatgaaggtttgcatctttcaccacatatcgttcctcaaattctacaagaacgccgtattccccgagggtctccttcaagagaccctagatacactggctctcatctttccaaacagcgaattcgggacggttgggggattcatgtgccggcgcagaaagtggctggaggagctctggtcgcggcacagagaccagtgcatagacaccgggacaggaaccggcgagagactgcaggctgaagcaagacggatagagaagttcaggttctggagagaccgtcttgtcgtgctgaagcaggcgtacgacgacgccacgccaagcagcatgtcccagtggtggcacgaccggcggaaccgggtggtatggtgtactttctggattgcaatctttgtactcatcctccggcgtgattgttggcgtcgtgcagtcggttctaggcggtattcaagttggggcaagctgaggcgccttggactgcgaggcaatcctcttttttttttccttctcttgctccaaaagctcactgccaacattgtcatctacgcaagcttattgggtgtcacggccaggaacatgagccaatgccgataa

SEQ ID NO: 362 - DNA, 3216 bp, Colletotrichum orbiculare
atgcccatcatcaggcagccctgggagcatgcgctggcatcatgcggtctgcccatcgcgacaaatgggttgagagctgggctgagggcttggtggcccgttggcgtagcccacgacatatatgagactcggctcaagtccagtgttgacgagcttgcgacgttgacaacggtcgagcatgccgtcacgttcattcgcctgtacatggtgggaaagtcggaggtcatggcgcaagcagtcatcatggtattttgcatggacgagcgggcggcggaaacgacgaaagaatgccctaaaaaaagtggcattctgaagggcttcacgggcttcaccctgggcgcgggttctctgccgttggagcttcagcgcccttcgcgactcttggctggagaaagcagtcgttcgaacctcggccaagccgcggagaacagtcttcggaacgcagatgtgttttcgacacatccctcgcctgttatcggcagacgctttctgaggaacgagggaggtgggcgtctgacatcatgggccgtgggaggggttgtgctccggtgggacgacaccttcttccagctcacagcggagcatacatcgacagaggaagaatccctcgatgagacatttgtctcttctccaagcatcagaaagtgcaccatcgatggtctggaggacatggacgactcttcgagtgacgtactcgaccacgaaatcctcagtcacggaagtgccacacctgaactgagcctgtattcaccaagcttcgtctccaggggggatacctcggatcaaatatcattggaagacggcagccttgccaactccatcggcatctgggaacccgatgataccttctcagtcaaggagaccaccggtagctctgacacgcccggtacatccttgtccacgacatatggtggaccacagccatcaggggatcgagactcaatcggaaaggtgggatccgtcgctctccagtccagcgagggtagccagcccggtctcgattacgccgcggtagccgtcgacgtatccttggactcggattttgtcaataacatcagcatcatcgatgacggtgctcggaaactattgagagtcagcgacgttgctacctcttccaacagagagaggcgagtgctactggcaacgcaggcggacagcttcaagacaggattgatcctcccaggaacgacgctgttcagcaagaaaggatccagctcattcgaaaatctcaagaccatacagttggacgagacagtatctttgggcgactgcggatctgcagtcatagaccgagactccggagctcttcacggccacttggttaggggctgtccaggcacaggtacggcctatgttgtgcctgcattcgacgtcctgcaggatctcgcctcaagaggcatcaaagccaggttggcaccttcggatgccgattcggtggagcttacaaagcagctctcgattcaacatcgaggcaaatccgctctcaccctagggatggaggaacttaggccaccagagacatcgggacggtacccaacaaggcaacactcatcccatggcgcagcggccaactggtcaaacattttctcgacacgtcgccctgtcggttatgacgactttgatttcctcaatcttacttcatgttacggggttagacccgaagatgaagtttgggacctgatcttcgatgatggtctctcgacagaagtcttccaagccgaagaactacgccgattttgcaagaatgtcactattgatggtcttcggagacatgaattccaaaagccttgcgtctggctcgatgatcgagactctctgagaaaaaagaaattgacaaggtccggatgcgttacaatcagcaatctttttcgtattctacgggaaaagcgagttgaggataccctcaaagcggacagacggttgctgtatatcccacgtttcagccccgaagctgcattcatcctcgccgcgtgcctcggaaaagatggacacatgctcggaacgctgatgtatcatcatctcacgtccaggcctctctttgacgtcgaaattcggaacaatcaacagtttggcatcaagttccaaataccctactacgtatggcgaaactcggaaaacaccagagacctggcctcggaaacgaacgtcaacgaggatggtgcgcaattgagtgacatctccttcctctttgataatccacgagcttctgcagcctcgacgtcgcaaactttgtaccgaagccagatgtcgttcatggtgctagggtatgataaatggcggtggactggctatttcatggcggatcgctttctcgagtcgcctgggaactgggatgttttccatggagatgaagaacacctaccatacggcttcgaaatcgatccaattcgctcgcactttgtcgatcctatttcactaatttggtcacctcgccaatatttcctcgtggtactcgaaacccgcctgaagcaggtggccaaagagtgggctcatgttgcgcgccgcctggagaaagcttcaaaatgccaaccttcatcattggacgttgggccgattggtgttgctgcctcgagggcaaacaacagaaagcccggctcgtggagaagccggtacattgcgttactaaccgaactcctccagactctctcagagaccatcgaggcctggaatcaattcgagagtcgcgacctgaccacgtcttctgacttttcgtccgaggacaccggttctcccacctatggggagttgcttcacagcgtcagaaggtcggcaggcgggctcaaactgtgccgcacgatgttggaaggacttcgtggaagatgcgagcgcgaagtattccacgaacagctgcaaaccgactctgacgttgtgtcacctcgtggacctactgaagcctcgaacttttatcttcagtacattctcgcagcattaagctccaccctgccgatcctggcagccgccagcctcgttgacatggacttcatattcacatcgactccagtagccttcggcgtttatgttgtgatattcatggccctcccgacgggcatcgtaattgccttgaagtcaggaagtatcttgcggaggagagttgcaaccgcagtacattctcgccctgcttccccttctgtggagtggagtggcgagcttcctcaccgccgacggctaccgactcttccattgttcaggcggcccaaaacaagagagattttgtga

SEQ ID NO: 363 - DNA, 6858 bp, Colletotrichum orbiculare
atggcgcccggcgtcctgtcctactcctcctccgggacatcgccatcagcaagtcctgtcatgatgaccccgatcgaccactccgacaccacttccgatggcttcactagtctctcggttggacccctcgacggagtcggcctcggcgtcaacggccagcacacgaacggccactccaatggccacacgaacggccacacgaatggctcggcctcggccgccccggtaggtggcagcgacgccggactgaagcaaatgcccatcgccatcgtcggtatggcctgtagattgcctggtagcgtttctagcccggccgaattctgggagctgtgctcccgcgccagaactggcttcactcccgtccccaaggagcgcttcagccacgaggcgttctaccaccccaacccgggcaagaccggagcttaccacgccactggcggtaacttcctggatgttgatctggcgtcgttcgacgctcccttcttcggcttgacggagaaggaggctatctcgatggacccccagcagcgtctgcttctcgagtgcactttcgaggctctcgagaatgccggtatccccaagcacacgattgttggaaaagacgttggtgttttcgtcggtggtagtttcgcagagtacgagagccacttgttcagggatagcgacacgatacccatgcaccaggccacaggatgtgcccatgcgatgcagtccaacagactgtcacatttcttcgatctcaggggcccgagtttcacagccgacacagcttgttcggctagtttggtcgccctgcacttggcttgccagagtctgcgcgctggcgagtcaacctctgccatcgttggtggttgccatctgaacatgctacccgagttttggatttccttctcgtcgtgcagattgcttgcagatagcggtcgctccatcgctttcgaccagcgtggaaccggtttcggccgtggcgagggttgcggtatcatcgtcctgaagccacttgaccaggctatcaaggataacgataccatccgtgccgttattcgtggcaccggcatcaaccaggatggcaagactcctggcattaccatgcctagtggcgcagctcaggagaaactcatgaaacaggtctacagaaacgcaggccttgacccccatgataccggctatgtcgaggctcacggcaccggcaccaaggtcggtgacccgatcgaggccacggccctccacaacgttttcggtcacaacaggtcagccagggaccctcttttcatcggatcggtcaagtccaacatcggccatcttgaggctgcatccggcattgctggtgtcatcaaggccgccctcatgctcgagagaggcttcctcttgcccaaccacgacttcaagcagcccaacgagaagattccgtggaaggagtggaacatgaagatccccgccactcagagaccctggcccaagaacaagaagtacatcagtgtcaacaacttcggtttcggtggcaccaacgcccacatcgtcctcgaaaaggcccccttcacccttcccaagaaggacaggaagggtttgcccccaccggagaacaccaagagaaccaagactggcaagaagctttacgtcctgtctgccaacgacaagaactccgtcaccgcagtcatgaagaaccttgtcgtttacctcgagcaacgacctgagattttccagaatgacttgatggacaacatcgcctacactcttggctcccgccgttccatgcttccttggagggttgccattcctgccgacgactcgtttgagcttattgagacgcttaacagcggcaaggtcattcctggaaaggagggtgagccgctgagaatcggattcgtcttcaccggacaaggtgctcagtggtggggcatgggccgcgagctttacagccactaccctgtctacaaggccgccatcgacagagccgacgagtgcctccgcaagcttggctctgaatggtctctcttggaggagttgaacagagacgccgactcgtccaaggtctctgatgctcacatcagtcagcctgcctgcagtgcggtccagcttgccctgaccgatctgctccgcacctggggtattcgccccgtggccgtcgctggtcactcttctggcgagattggcgctgcttacgcagctggcatcatcggattcgacgccgccatggctgttgcctaccaccgaggtagacttattcctatcttgaagaagagacacccagagcttcagggtgccatgatggcagtcggcggcagcaaggaggaagttcagcccatgatcgacgctctgaaggagcagcaggtccgcattgcttgctacaacagtccctccagcttgaccatctccggtgacaccccggctcttaccgagctcgagaagattctcgaggagaagcagatgttcaacagacgcctgcagattgagactgcgtaccactcgcaccacatgaacttggtcgccaaggaataccgcgagtccatctccgagctcccccacccccatactaccgatgtgcgcttccactcctctctctacggtcaccagatcgatggtttcgagtgccaggctcactactgggttaacaacctgacctgcgccgtccgcttctctgaggcccttgagaccatgcttgagcctgtcggtgaccacaagcacggtgtcaacatgatcatcgagttgggtccccactccgctctccagggtcccatcaagcagatcctcaagcacgttggcgagtctgcgacaaagattccctacgcctctcctctcatccgcaagaaggatgctgttgactcggccatggagctggctggcagtgtcatcaccaagggagccattctgaacatggacgcaatcaactttcccacgtccgccaagaagcccgcccttttgactgatctgccccggtacgcctggaactaccagaataagtactggcaggagtcccgcatgacacagatgcacaagtaccgcaagtcgccgaggaacgacttgattggtctcgaggccatctactccagcgatcttgagcccacctggagaaacattgttcatctcgacgatcttccttggttgcgtcagcaccagattcagtccctgactgtcttccccatggccggtttcattgccatggcactcgaggcttctgcccagtgggccaagcgcaaggagatctctttcgagaagtttgagctcagggatgtctctgtcgtcaagccattggcactcaacgacaccgatgtggagatgaccatcaatctgcgccctcaccaggagaccaacctcaccgcctctgagacgtggaaggagttccgcatctgctcctggaccattggcagcggctggactgagcactgcgtcggccttattgccctccacggcacagagaccaatgaggtcgacggtaaggagcagaagcttgccgcccgccgcggagccgaggctaccatcaaggctagcgagggtcccgactcagttgctgtcaacgaggccgacatgtaccagcgcctgagcgagctcggcgttggctacggtcccagcttccagggaatcaaggattgcaaggcctccaacaagcactctgttggcagcattacctccgccgatatcgttgcggacatgcccaaccactatgccaccagcactgttcttcaccctaccttcttggagtctcttattgagatgtactggccgatcctcggagccggccgcaccaatctcgacacagtatacctcccatcttcgattgcgagaatgaccgtcgctcgcgacatcaccgccctcacaaaggaggccggcagctctttgaaggcttacgccagggctgacttctcggccaccgaggctcgccccaccaaggtctccatcttcgcgacgtccgagtccaaggacttggtcatcgagattgatgatctcactgtctccccgatcattgacggcgagactgagcgtgccaacaaccccgcccgtgagctctgctacaaactcgagtgggagaacattggcgatctcaagtccctctccggcaagaagaagagcagcgccaccagtgttaaggttgatgctcccctgcctgacgtcgacctcgccatcatccacggcgagtccaactcccagcagatgttggcaaacggtcttgccatcgcccttgccagctcgacgtcgagactcccagagatgggcgctctgcacgaggtcaacactgaaggcaagctttgcattgttctgaccgagctggagcagcccttcctggcgaaccctaccaaggagcagtttgccgatgtccgcaacatgctcgccggagttcagggctgcctctgggttgtgcgtggtgcctacgacaaggctacgtctcctgagtcgaacatgattgttggtctcagcagaaccgttcggtctgagactgtcttgccattcgccactctcgatcttgatgacgccaaccagctggacgaggacgatgcttctgctgtcatctatgagatcttcaagcttgccttcaacaccaacgccaattccaccagcgagcttgagttcatggagcgctctggcaagtttttcactcctcgcatcgtccacgacgaggacatgaacgagtatgtccaccgcgagaccaaccccagcattgtggagatgcagcccttcggcaaggatgaccgctgcctcaagatggagtttaccaccccaggagccatcgagaccgtccacttcgtcgatgacgtttcggtcagccaacctcttggtgatgacgaggtcgagttcgaagttaaggctgttggcatgaaccttcgcgatgtcattctcgccaagggtcaaatcccagacgccagcaagcacgctctcggtgttgaggctgctggaattgtcaccagagtaggctccgctgtcaagtcccacaaggccggtgatcgtatcgccgccttgactatcaagaacggtgcctacgccacccgcacccgcaccacggctgcgagcgtcatgtccatccctcccaagatgtcatttgtcgacgccgccaccctgcctctcgcctactgcactgcctactacagcttggtcgagcaagcccgtcttcgcgagggccagcgcgtgctcgtccactctgccggtggcggtattggacaggcctccgtttgtcttgccaagatgatcggcgccgaggtgtttgtgactgttagctctgcggacaagaagaagcttcttatggcccactacaatgtccctgaggaccatatcttttacagccgcaacaccacgtggagggctgcagtccgacgcgccaccaatgacgagggtgttgacgtcgtcctcaacacccttcctggtgctgatgctcttcgggagagttgggcttgtctcagccgcttcggttgtctcgtcgacgtccgccgcaacgatggttctcgtgccactcgcttggacatgggccagaatgacagcaacgcctcgttcctgagcgtcgacgtcttcggccttgctgccgagagacccaagatcatggagagactcgtctccgatgtcgctaagctcctggctgatgacgagctccgtcccatcgaccctgccaccgtcttcccagtctccactatggagaccgctttcaagacgctgcaaaccactcagggccctggcaagcttgttgtcgtgcccagcgctgacgatgtagtcatggctactccttccaaggcgaaccaggaacttctcaaggccgacgctacttacctccttattggtggtactggcggtcttggccgcagcatgtccagatggatggttgcccacggcgccagaaatctcgtcctcctgtcccgcagtggctccgcaactggcaaggtcaaggaactcattgatgaggccgccgaggaaggtgcccacatcactgtccgtccttgcaacgttgccgacaaggccagcgttgaccagctcttcaacaccggtctcaagggtcttcctcctgttcgtggtgttattcacggtgccatggtccttcgcgatgttctctttgagaagatgacctacagtgactacacgtccgtcacggagtccaaggtgcaaggtgcatggaacttccaccacgccctccaagagcgcaagacagcccttgacttcttcatcgccatttcttctgctgctggagctgtcggcaaccgtgggcaagcagcttacgctgccgccaactgtttcctcaacgccttcgtccagcaccgtctgtccatgggtcttcccgccacttctctcgacctgactgccgtctccgacgctggttaccttgctgatagtggcgcggagcgtgcggcagaggtcgccaagaacctgggttccgacacgatttgcgaagctgaggtacttgcccttatcggtgcttccatctctggaaaaacctccgtctgcaaccaacacgtcattactggtatgcgcattactcctacagttcagcccttctggactcccgatgccaagttcaagtccctccgccttgctgcggaggagttggccgccgccgaggctggcgcaaacggtgccatctccctcaacgctgctctcaaggcctctcgcagcgaggctgaggccatggaggttgtctgccgcggcttggtggagaagatcgctgctgttctcatgatggagcaggacgatcttgacgtcacccgcagcttgtcgcactaccccctcgactctttggttgcgatcgagatccgcaacttcatcacgagggagttcgaggcaaatatgcaggtcttggagttgctttccagtggaagcatccagaccttgaccaaggctgtttgcaagaagagcaagctctgcgtcgggtttgattggagcagttag

SEQ ID NO: 364 - DNA, 771 bp, Colletotrichum orbiculare
atgcgctttctctgccttcccggtgcctacggcagctcggacaaattccaagtacagctcgctcccatcttgaaggaactcagtgaagacggcacggcaacatttcacttcattcatggaccctgcaaggcccttccgcctccgggctttgaggactactttggagccccgccctactaccgcttcatcgagcccgataaggatgtcgagaagacccagagcgacgacgttctcgctcgtatccgcgactttccgcaatgcgagacgtcagaggacaccatgagggagctcatgagggagggtattgcgacgactcatcgcagcaccgacagagccatcaagtacatcagcgacatcgtccagaagactggcccgtacgatggcatcatcggatactccgagggcgccaccgtggcttcgacattcatgctctatgagcagcgccgcctgcagcgttccggccagaagccggcgttcaaatttggcatcttctttgccgggtggccccctgtcgaccccaagactcacgctcttgtcctgtctgacgagactgacgagaggatcgaagcccgcaccatgcacattatcggatccttggacccttatgttgacggctctatggccctgtacaacatgtgcgatcccgatacggcctacctgttcgaccacgccaagggacacaccctcccgcgtgacaaggacactatcaaggaacttggcgacattgtgcgcgagacgaaggcagacatgcaggccgaaggtctgctgtaa

SEQ ID NO: 365 - DNA, 4047 bp, Colletotrichum orbiculare
atggccacgccggccggcggcgcttatgcggccgctccggcagcggccgacgaggcccctggggttgccaacgcccccagcgatcctgccgcgacgccgttagagcctcccagggcgtggtggaagctgagtgcaagcaatgtcgcgacgttgcgcaacttttgtaggatcctttcgtacggaacatggatggacaagctgatcatcatggcgtccgtgttgtttgccattggctctggactcaccatgccggtgatgaacattgtgtttggacaacttgtcggcacgtttaccggtttcttcaagcagggcacctcggagacgcggtccgacttcaccaagtcggtcaaccagggcgtcttgtacatggtctacctcttcatcgcgaggctcatcctgacctacctctccaacctcgggttccgcatgacgagcatccgcatttccgccgcgatccgcctgacgtacctccgctcgctcttcgagctgcccatctcgacgctcgacatgctggcgcccggccagacggcggccatcatcaccatcacggccagcatcctgcagctgggcatatcggaaaagatgggcgacttcttcaactcgctcgccgtcgtcatcgcgggcatgaccatcgccttcgcctacaactggctgctcaccctcatcacggcgtccggcctcgtcttcatcctcttcgtctacatcttcaccgcgccgcccatcctcaagcgcctctcggacgtccaggagatggacgtccaggccgcctccgtcgccaccgaggcctttggcgcgtacaggatgctggccgcgtgcggcgccgagttcaagatgctgcgcaagtacggcatcctcgccgaccagtcgaggaagaggggtgccggcatggcggtcctggtcggacttcaacaggggctgatctttttcgccatctatgcgacatttgcgctggccttttggtacgcgttcaagatgtacaccatgatgaccctgaccagcccggcctctctcatcgtcgtccttctctgcgtcatgatgatggcctcctccatcggccagctcacggcaccgctgtcggccgcgtcccaggcagccgacgccaacgccatcttccacaccatcatcgacgcccccaagcccgcgtacggcaagctcaaggccccccaggcgtccgccgagggcgacattgtcttccagaacgtcaactttgtctaccccaagcgccccgacgtcaagatcctcgagaacctgtcgctgcagttccccgccggcaaggtcacggccattgtcggcccgtcgggttccggcaagagcaccgtcgtcggtattctcgagagatggtatgagtttgacggcgatgcccagacgaaccagctcgtcctgtggctccgaaacggcatcatcagctgcggcggccgtcttctcagcgaaatcgaccccaagtggtggcgcaaccagatcggtctcgtccagcaggacaacgccctcttcaacacgagcatctttgagaacgtcgagcacggcctcatcggcaccgagtgggagcacgagacgtacgccgtcaagtccaagctcatcgagcaggcctgcaaggacgcctttgccgacgagttcatctctcggctccccgaaggctaccaaacccaggtcggcgacgccggcctcaagctcagcggcggccagcgccagcgcctcgccatcgcccgcgccatcgtcaagcagcccaagatcctcatcctcgacgaggccacgtcggccattgacgtgcgctccgagcagatcgtgcaggcggcgctcgaccgcgccagcaagggccgcaccaccatcgtcatcgcccaccgcctcggcaccatccgcaaggccgacaacatcatcctcctccgcaagggccaggtcgtccagcagggcacccaccagtcgctcatggaggacgtcgacgggccgtactacaccctcgccaccgcgcagaagctcgacatgggcgccgaggacgacgacggcgaggtcgacgacatcttgttcggggacctcagctggcgccgccaggagcccgaagagcgcagccccgtccgcaagtcgatgccctttgccgacagcgagggcgacctgacggagaagcggccgagcagcgacggcgaggcctctggcgacgcgcccgtgaccgaacgcgacggttccgacgaggagctcgagcggaccgaggccggcacgctgagggtcgtcaagaagcccgagggcgtgtatgcccgctggaaggcgtggcatctgtttggcagcttcgggcagctcctcgccgagcagaggaagcgctggaagacgtacattgtgattgccgtcggtgccctcggcgccggagccagcactcccgtccaggcctacctctttgccgtcctcgtctccctcttctcgtactggggcaccatcctgcaaacgattgcgaaccactggtgcatcatgttcgtctacctcgccgcaggggtcggcatcagccactacctcctcggctgggccaccaccaccatcggtttcggcatcacccgcgtctaccgcaaggagtacttccacaacatcctctacaagccctcggccttcttcgacaaggaggacaactccgccggcgccctcaccgcgcgcctcgccaccgaccccaccatgctgcagcagctcctcggcaccaacatggcctttgtcctaatctccctcttcaacgtcgtcggctgcgtcgtcgtcggcctcgtcttcggctggaagctcacgctcgtcgcgctgggcacctccatgcccatcatcgtcgccgccatgttctaccgcgtgcgccacgagacccggttcgaggaggcaaacaacgccgtctttgccgagagcgcccagttcgcctcggagagcatcggcgccatccgcaccgtgtcgagcttgaccatggaggacggcatctgccgccgctacgaggcgttgctgcagaaccacacgcgcgaggcctttcgcagctcgaggttctccgtgatgctgtttgcgtttagcgacagcatttctctgttgtgcatggcgttcgtcttgtggtacggtggacgtttgctgtctgaccacgagtatacgccgttccagtacatggtcgtctacatcgccgtcgtgcagggtggaatgtccgccggccaatggctcagcttcggacccaacatcgccaaggccaagaccgccgcggaccgcatcctcatgatgcgcgaacccgaagaggaagaaaccgcacccgcggccgacggccgcccctccgacgtcgtcccctacgaggtccaccacgaaaagggcgtcgagatcgacttcaaggacgtctggttctcctacccgacccggccgctgcccgtcctcaagggcctcgacctgcacatcgagcgcggccagttcgccgccatcgtcggcccctcgggctccggcaagacgacaatcatctccctgctcgagcgcttctacaacctctccgccggcgacatctcgtacaacggccgcgacgtcaacacgctcgagctcgcaaggtaccgccgggacatctccctcgtcgcgcaggagccgtccctcttcacgggttccgtccgcgacaacatcctcctcggcgtcgaggacgaggccgccgtctcggacgaggccctccaccgcgccgcccgcgacgccggcatccacgactttgtcggctccctgcccgacggctacaacacccaggtcggcacctcgggcgtcgccctctccggcggccagaagcagcgcgtctccatcgcccgcgccctcatccgccgcccgtcgctgctcctgctcgacgaggccacgagttccctcgacagcgagacggagcgcgccgtgcaggccgtctttgacgcgacaaagggcagcaggaccatggtcatggtcgcgcaccgcctggccacggtgcagaacgccgacgtgattttcgtcatggccgatggcaaggtcgtggagaagggagaccacgcgagtttgatcgcggagcggggtgtttatttccaaatgtgtcaatcacaagcgttggacaagtaa

SEQ ID NO: 366 - DNA, 2097 bp, Colletotrichum orbiculare
atgaacggcattcgcaaggccatctacacgtataggacctcgaccgagagcggcgtcgacgtcatcgtcaacaaggcttttgccgagagacggttcatgcttgatgtctttatgacgcctaagcctttgccatgcactcttcctaccgttccgctctcgcaactggctctacatactgggcaccgccctggatctcgaatgtggatcggagttcatggcagcgtctacgatgtcaccgacttctgccccatgcatccaggcggaacgctcatcatcaagtccaacgccggtgtcgattgttccaagtctttcgacaacctcgcccacaccaacaaccccgaagtgtccagtcttctgaccaagtactttgtaggccacctgacaccgaagccggactgtggcagcgacaacatctcggcgcttcactatctttggtcggcatatctccgtactaccgtcgagccactcgtcgcccatcagttcgagatgtacgagatcatgggggcctccctcgaaacgtcatcttcacatgaccccgcgggaagcaacaacatctggttgcgcgaaagccttcccaacatcattgccgttcgtactttctacagctaccagtcgcgtctgcttcagggcggttttgcagctctgttcgctcccaagcttcaagagctagttctcaagctctcctttggcgtcgccagtgccaacggaccggcagcagacacgaagctgccagacgttctcggcactgtcgcccgagccaagaccagcagcgacgctgcgatgtgcaccaaagaaatcgccctcgtgggccagtttgtgtgcgacgccgatgccactcttcgcttccaagaacgcggcgtctttgcttacgccgcacgaagcgtcgagcttgacgttgctttcctggaagaccttcgccaagaagcttgcaacggcatggacgcctttgatagcatcgcagcctcaatgaaggagtttcaggacccggacgtcgagaacacgcgcctcgcagccctctccacatttctcttgcaagtcctcgagcgcatagcccgtcacctagaggtcttttacgcccagctggcgcgttcctcggtctaccagccccagatcgagaagaatcccgcgcgcacacgctgggccctcgtccggcgacgtatccgagacggcagcctgttcgttcttgcgaccaaggctgagctctcgggggacctggtgcagcaaacgacgtattacatgtcgcgcgcgaacccgaaccagaacattgactttgaccgcgtcatggcgcaagtgcagactaatctccgtaccggcagccaagacgtttctcatctgcaagcgcagcagcagcggcctacgacactcaacgccgtgcaccaggcccgaggccgtagcacgggagccgtcagcgcgatcgcgagccgcgagaacgcgaacgctgtgagggccatgatgggcttcgtcgagaagaacggccgtgcaatccggcgtctgagtaagatgcccactggaatgaactttgaggatatccagagagcagcgctggagctggcacagggaaggtccatgtcgccgcccgaattgacgggtgacgtgctgtcagaatacaatctgaaaggcgcaaagacgggcagggctctgcccacgccaccgtcgagtcgaggatccagtcgctcccccacgcgattcggcccgctgggtgcgcacatgggtgggagaccgtctgccgagcagctcctttccaaacttaatcgaccaagaggtgcatctttgaccagagcgggcgccagctcactagcgccataccccgtcatcggccatgcctcacctccggtggatccgcagacggctctgagcacgatgatgagccgtctcaacacacggccgcgcagcgggtccgccaccatggctccgtctcagaataatctcacccaaagcggcgggttggcgaggacgagatcgttgatgagcgtggacagcaatggtggcagggatggaaggggccaccgcgtgccgcgagggtcgacgagttccttgcggactctgaagttgaggagcgtgatggaaagcgaggagagggtcgcgccgacattttag

SEQ ID NO: 367 - DNA, 2586 bp, Colletotrichum orbiculare
atgggtccccgaggatgctccttttctggcttttcccagccaggcgatgttcatgccgcctttgatatcccccgaggagtcgaagccgaggaatggcttcgcatgcgggaacgaaagtccatcaaccaggttctctattcgagctacccttctataccagaaatcgacgcagccaaggaccaggctcaaatggatgccttcaacgtcagcgagcaagatcttcttgccgttgcccttggggctccggcaagacaggtcatgctcagagcggaagaaatcggcccgcagaccggttggaaggactgctatctcagcatggaacacggcttttgcccgcccgactatgacgaggccgcaggtgccctggctagatcaccaggtcgtgtgtggtctgacctttgcgaacgcatgcccggctgcgtttcccgcggccgagtcagagaatccatcgccgctgcgcccaccatcgaaggcaccgaagatgtcataccagaccaagctctctgggctgctctcgtcgcgctggggatgctctgctccatctaccgctttgagcaaaagtacgacggccaggacggcgtcaatgcttcgacgaatccaacaaagctaaggctgacctgtaggatgggcgatcaccttggagaggagctgcttggcattcccctttccatcgcactgccttactttcaagtgtcccgccgcatgggaaggaccttgccccacctcacattcgttgatcaatcatcctacaatctcaagatcaaggacgccacatcgagctacccctatgtcgcacgcttcgataacatcgaactgaggtggcccatgttcggtgagagagccgaggttgccttcctgaagggtgttgcagagacgtcagcctccttccagcatggacctgacgccattgctgcctgccaggaacatgtaaggaaccgcaacgtcgagggcctccttcacgagatgatccgtctcaaggaaattctcgagcgcatgccgaacgcattccactcgatttctacgaaccccaacgctggcgagaactacgtgccggttcagcaatgggttcgctgggctaagttctctgcacctctttcgaagcgctgccctgcctcttcaggcctacaattccctccttacttggtcatggatgcctttttgggcagaaaaaagtatacatccttcctcggggctgagggcgttcacctccgagcctggcttccttccaacctgcgcgccttcatcgcggccatcgaataccattaccgagtgcccgagttcgtccaacaatccggcgacccaaggctgatgggcgttctcgacggcatcgtcgaggcttatactggcgaacgtggattcatgggggtacatcgctacaaggtctttggaatcctagaggtcgccgccaaaaccggtcgcaccgagaccaacggtgcctccggggcggctgacggagaacgcccttgggaagaaacacatcgccagttttccgaggccatgaaagaacggctagagccctatcgtggagcgctgccagtcgagcctcatcagatgcgaggcacgttcgaagaatgccgctacgttaccagagtgctgaacaggtcttttgtcgattctgatcccgcgcgctcaatagcgatggtgacgctcgatatccgcgatactggcattacatttgctcctggagaccgcttggccgtgatgcctctcaacaactgggaggagtgcgccaaggtaattgctgccctgggtctggaagggcacatcgacgcgcctgccagcgtcactggaacatgggctcgatttgagtcgcacctgggcttcgtgaggaggaccgcaacccccaagttgaccgttggcgatattttacgccgcggccatctagcgcccatcaccaaggacatggctctcaagatctacagcatgctacatgcctcgtctaacacagtgttgcaggacgccgtcacagatacgcctcctcagatctgggaccgcgtcttcaacctggatgacctgtcgtggctagcggagctcatcccaccggaggtaccacgaacctactcgatcgcaagttttaccgaagagcttctgccggagactgtggatctggcagtatcccggtcagagtataagctgtgttccacatttgccagaggccaggacatcacgcgagctggcgtctcgtcggggttcctcaccccgccggtggagatgagccagattgaatccgacgatgagatcctcattggcgtctcgcgcccagcagctggcatcgcgccatttcgcagtttctggcaggcccgtctcacgcagagtgggctctctggtgggaaaaaccagctgtacctcggcgtccagtctcgtgagaagttctgcttcgaagaggagcttcgacaatacgtggacgcggactttatggaagtgcatgtcgcattttccagggactcccgagggctggcctacgaaggccgggacctagtcgagaaacatatccctccccgctacatcgatacgctcatcgtcgaacaaggcgcttccatttgcgatcttgtaatgtccaagaagcagggtggtcaaggtggttaa

SEQ ID NO: 368 - DNA, 2691 bp, Hirsutella minnesotensis
atgccgtcgacgcaagatctactcgaccaatactcggaccaactggtgccgttttcattccacgccggcttcgtctgtttgagctatgccatcagtctcttggggaccggctcaactctcgagttgatgaggcggcgcacctctcaccggggacttcacaatctcttgctcctggttggtgcagccatctccatgggagggatcgccatctggtccatgcactttattggaaacagagcaatctatatttttgatggtcgagaggacatgcaaatctcatactcgactggcatgaccatcttgtcgcttcttgttccgattcttgttcttattctcgcgttccttgccgtcagcgttaatggccgaatccgttggtggcgtattggcattgcgggcttgctttcaggcggtgccatctgtgggatgcattatttggcagatgcctccattagcaacttccaaacgacatacgagatcggttatgtcgtcggtgccgccatcatcgccgtctccgcgagcacaacggctctcgctatcttcttcgtcttcgaagccgcatggaaagttctctggtggaagaggctaggatgtgccatggtactcgctggagccgtctccgggatgcattggtgcgccgctgttggtaccagctatagattaatccgtctgcagtctcttcgacagggaatgtcgcgacattccctgtcgatcatggtcatttgcttgtctgttgctgcttgtattgttcttacaatcagtggcatttactctagctggattcgccgcgactatgccagcaagtcacaaaaggtcgttttggccgccgccgtgttcgatgaggagggcagaattatggtcaaccaggaaggttttcttccaagcgaagtagtcacggacatgctcatgaccaagtcgcatagcgagatattcgacacatcgcatcctcttttccactggatgtatcgtgcttcccgaaactggccgagcatcgcgtccttgaccgacaagatggcaagccatattggccatgtggctcaagaccggtataatggacgagcacggcttaagttggtcaacgaagatggaacactagtacaacactatgatcagctcatctgcgagttgttctccctagccgctttggctctggcgaataagactaaggaggtactgacaagcgccggtacgttgtgggaagaaatctttgttacaggcaatacagcgaacaatgacgtcttttcgaagcttgacgactcgagccttgcggcaaaagcaggttttagtaagaacgccaaggctgttaaggataaatcagtttttgtcaacctggccgaaaaggggttgattcctatgcaccagcaatatggtcgtggttgcctcatgttcctcgtgcgccacatcaacgccaggaaggatctcgacaaactcgaggcggccggataccggtttgcagaggttcaccatgtcgtgggcaccattcgctcgagtatgcagattagcactccagactttgccacgcgactacgcagcatgtcagccaaccccaagcgcggcgccacgcttgcccccggcgtccatctcggcatctttgcggttcgagcgaggctagaccattgcggcttcgacgtcctcgttcagaaagacgccaagaatctcctgccgaccgccgagatacctttggaacgtcttgagccctggcaggttgacttcgtgaaccgtcttaggggccttggcccgttggccatcattgaaagactcaacagcgaccatcgcttatccccgcaagaggcccgcttggcttctcatctgcgaaacgccattgctactctgagatcgtctctcggtaatctggcgttcagtgatgccactctcatgtctcaagtggtacatgcaccttgcactactcgggaagaaaatcctcgcttgtcaacatgttcactcatttcgtttcgcatgattcttcccattcacagcgtggctcgtctcccacaatgcgagtttgttccgcttagcttcttccgggtccaacaacaggtgtacgcagaatcaccctatcaccttgagttcgcgcatatggtccatcgggacctttcatctttacttcacaacatcccgtcatcgacacctccaaagacgccgcagcggtcttccacgaggcgctcacccggatggatcaataggcttcggtccgagcgcagccctagcaaagtggttagcctccagctttctgccagaagtcaagaacgactgtcgactggtacttttaaccccatgtcaccatatcctcagagcgattccatgagtttcgacgactgccgcaagcctcaattcggaaatatcgcaccatctcccatgggtcacgtttcctgcatgcgggcgccatcgcctgtcaatagtagctccataaaccaggacaaacagctcttcggaggcatcatggtatcgcaacagatcatggtcgacgtacaagagcttccgaacgagcgtatcccttcaaacgcttcacgccctgaagatgtaggtagtcccgagacgcccgtctatcaggatgccaaagatcctccccgacaaggaaacgggttttcagctgttgctgtcggtgagaatggctccgcggcagccagggatcaaggaggtttgcgattcattgacgatttgctctcattgtgcatggaaagatccgagttttag

SEQ ID NO: 369 - DNA, 2277 bp, Hirsutella minnesotensis
atgaggatcttattcctctgcacagcgcacaactcgctgtcacagcgactgttcctagtcttgtcgcgcaatcattcagtgacaatcgaatatgcgctcaccgagtcgataatgattgaggccgtcaacctggccaacccgcacattgttctctgcccattcctcacgactcgagtgccgcgccagatatacgagcaatatctcacgttgattgtccatccagggcctccgggagatgctggtccgagtgctcttgattggctcttgatgggggacgatggtacagaggcggtctccgatagactactcaccaacgactcctttagctgcagtgggcgcagccactggggggtgacggtgctccaggccgtcaaggagtttgatgccgggcccatatgggcttttgaccagttcccggtcaacatcgacgagcccggactgacaaagtccagcctgtatcgtggtccggtcacacaggcagccgtcgcagcgacggcggcagcgatcgacaggatcgaggcagcggccctcgttagggccaccatcctcggggaatcggcttcgccacccagctcacccggatgcgatggccctccgagccggagccacaccttttacacgaatctactcacgcagcgggcttttggtcgattttgtgtgtcttcctctcagccattcaggggcggccagactcacaagaggccgctgctgcttgcaagccaaagaggcttcgatccccggaatcacgacgctgccgaaatctctcgcaggattcggagcagcgactcacaaccaggttgcctcagtgccatttttgggccaaagctttatctctacggcggccaggtagaagatgctgcgacctcggcagtcaatcccgccacctcaccggggcaaattgtcgccatccgcaacgaagccgtctgcatcgcaactcgcgatggtaaaggcgtctggatcacgcatatccgacgggtcaagaccaaggctgacgcagcgctatggcctaaagtcccagcaattcccggcctcgccgaggccggctatcgtacaaatgtcgacacgacggggatccttttgcccgacaatgctattcggagcctaccgaagcattggacacgagcaaaccatggcacatgccaggagatatgggttgacttcgcagctgagagctttggtgtcttggctcacgtccacttcgacttgtacaacggcgccatgagcacgcggcagtgtaggagactgtgcgaggctttggatcatatactgtcggtttcgaatcgcccggagagcaagacacggcgcctggctgccgtcgtgcttcaggggggtcggtcctatttcagcaacggaatccacctcaatgtcatcgagtcggcggccaatccgtccttagagtcgtggcacaacatcaatgccatcaacgacgtcgtcgagtacgtgcttggacactttccaagaagaggcgtcaagacagtcgccgcagtccgtggcaattgcgcggccggcggtgtagcactcgctgcagcgtgtgatgttgtgttggctggcgaacatgttgttattaacccagcttaccgcgccctgggcttgcatggatctgagtttcatagtctcacctacacggggcgatgcggcgcccaaggggccaaggcagctctgaggtcgatgttgccgctgagcgccgacgctgccgtgcggttgggactcgtcgatcatacagtgcccggatccgggactctgctggaagcggcgatgcggcatcgcatcaacaagctattcacttcaaatccaagtcaagtcgaagaggacagcatcggctgctggaaggataatgtaaatctttccatatcatctctggcacgagcacgtgccgcggagctggctgaaatggccatggacttttggagtgcacgagcgcaacgttatcaccgccgccggtatgactttgtgcgcaaatccaaggcaaagtctacacccctgaggttcgcatcgcatcgccgagaacagggcatgcttgacgaggaggaggaggacaagttcgactcgatcacattctttgaccaaatcgcgaagcaggatgccgttcaggacttatcgatgaagatgatgaatgtaatcagcagatactcacaagcaccagtggcagaggtacatgggacgtggcgacaaggtgaggcggttgctacgaaagcacttaatggaatggaaaagagtggcgttgcggcagatacatcgggctccttgttttcatgctattacccgcatgttttgtaa

SEQ ID NO: 370 - DNA, 759 bp, Hirsutella minnesotensis
atgaagtttctttgcttgcatgggtcttttggtagcgcagtgaactttcaagttcagttggcgcccttcgtcacagaggtggagagatctacccccggaaggtttagctggatagacggtttccatcgcgccgatccacccaaggggttcgaccagtactttggtagcccccctttgtacaagtttgtgggctacgacggtgtcatggccatcaatgaactggtcggccgactccagtccttcccggccagcaacgcacccgaagatactattcgacagcttgttcggggagacgatgtctactcgggagatgccgttcgaaggacggtcgacaggttactagacatcattcaggcagaccccgaaatcgagggaatcctgggttactcggaaggggccatgaccgcagctaccttgattctggaggagaagctgagatgggaaagtcaaggcgttccgcgcaggataaagtgcgcaattttctttgctggctggccgccggtccgcctcctcgagcagacggtggaaccaatgctggcggatgagagcgaggatctcatcgacgtccctacatgtcacattattggctgcaaagacccctacgtccacggcgcattggccctcttcaacatgtgtgatccagatacggcccaactattcgatcatggccaaggccatactctgccccgagacgagaagaccattagcgaattggcatgttatgtacagacgaccatagacaagtgtgtgcaagtttga

SEQ ID NO: 371 - DNA, 6756 bp, Hirsutella minnesotensis
atggcctccaaccatgggcaaaagcctgtccccattgccattgtcggcatgtcatgccgcctcccagggggaatttcgacactcgacgacttttggaccttgctttctcgagctcgatcaggctggggagagatccccaaggaccgcttcactgccgaggcatactaccacccaaacccgcaaaagaagggttgcttcaacacgaaaggaggttacttcttgaaccatgatccggccaactttgatgcccctttcttcaacatcacacggcaagaggccactgctatggaccctcaacagcgaatgctattagagtgttcgtacgaggctctcgagaatgccggcattgcaaaagaaggcatagctggcagcgacatgggtgttttcgtaggcggtggaccgtcagattatcaatacggcgccttccgcgacctcaacaccattccgatgttcgacgtgactggtaaccaccagtcaatcctgtcggggcgaatttcacattacttcgatcttcgaggaccgagcttctgcgtcgacacggcatgctcttccgggctgtacgctctccaccaggcggttcagagtctacgcgccggtgagtgtgaatcggccatcgtcggtgcctgccatctgcatcttcagccggagagatggattacaatgtccatgtctgggctcttcaacccggaaggaaagacctttgctttcgatcaccgagggaacgctggcttcgctcgaggtgagggcgtgggatgcctgatactgaagcccctggacaaggcgctcagggacaacgataagatcaagtcaattattgttcatactggcgccaaccaggacggcaagacagttggtctttcgacgcccagtggcgaagcacaagagcaactgattcgcgacgtttacgcaaaagccgggatcgacttcaatgataccgggttcattgaagcgcatggaacaggcaccaagattggagacccgatcgaggccagagttatccacaatgtcttcagtgaaggtaggacaaagcgacagcctctttatattggttctgtcaagaccaatgtcggccacctcgagaacgccagcggcatcatttctgtcatcaaggcagcgatgatgctcgagaagggattcatcctgcctaacacaaattacgagaagacgaacgagaacataccgctggatgagtggaacatgaaggttcctaccaccttgagatcatggccggcgcagaagaaatacatcagcgtcaacaactttggttttggaggttcaaacgcccactgcgtattgcaacgcccggctattgacttcgagtccattgtccaggagaaatcagatggcgtacacaagctcttcgtcttgtcaggccatggagaggaagccgcgaaagccagggctaagcagcttggaatctacgcagagcaacaccctgaggtcttccagaagcgtctggtccgagatctttcctatacattgtgtgaacgacgtagccacatgccgtggcgcattgccatcactgcgtcgtgttgcaatgaggtggtcgaagctctcaacggcatggatgcgaagccaagccgagcatccaagcccccaaagatcgcgttcgttttcacgggacagggtgcgcaatggcacgccatgggaaaagagctaatgggttcacacatcgtctttgccgacacgatgcgcgccgccgataattgcctgaagacgttgggcgcagatttctcactactcgaagagctcgccagggataaggacacctctctggtcaataaagctcatctcagccagccagcttgcacggccattcagttggccctggtcagactcttttcctcgtggggcatcgaaccccaggcggttgtaggccattcgagcggagaaattggtgcagccttcgcggctggcgcgctttcactcgaagacgcgatggccatcgcatacttccgaggccaagtcaccctgaagatgaaggcacgtcatcctgaccttcgcggctctatgcttgctgttggttccagccccaacgacgttcggaagaccatcaagaccatgaaccttgagggagctgcagtggcatgcgaaaattcaccaggttcaacgaccgtctcgggtcacaccgatgccattgacaagttggccgcagagctcgagtcacgaagcatattcaatcgcaagctttacgttgacgtcgcgtaccactcgacgcacatgaatcttgtcgctgaggattaccaccggtcaatcaatgcaatcaataccaaggacgaaaacaaagtcactttcttctcctcgttgcagggaaggaaactggagagttgctcgatgctcaccgcagactactggactgacaatctggtcaaacctgtcctgttctccccggccctcgaagctctttgtgccgaaactaagccttctgtattggtcgaaatcggccctcacgccgcgctcgaagggcccatcaagcagattttacgcgagatgggccagcaggcgagtcatgtcaagtactgccctagcctgaagcgaaaccagaatgccaccgaagctgccctcaaggccgcaggaagtctcttcgtcatgggtcagcctctggcatttgacgaggtcaacaatactctgcgtgaaggtgacgcaccaatagttcttgacgactttgcgaattacccctggacgtatgaaaggtattggattgagcctcgcatgaacctgggaactcgcattaagccatttgcacggcacgacctcctgggactgctcgagacttcgtcaaccgagaacgagcatagctggcggaacgtcataagcactgatgacattccctggttgaaagagcacaagatgcagtcgttgacgacattcccacttgctggatatatttccatggtcactgaagccgcatcccagcgtgcaaacctcaggcgtatagcattcgatcgattttgcatgcgcgaaatacaagcaaaagcccccttcatcatgaacgacggagacgagtacgagaccatcgttcatcttcgtcggtatgctgaaggcactcggtcgtattccactgagtgggatgagttcagcatctccacgtggatctctgagcgaggctgggtcgagcattgcagaggtctcgtggctgtgcgcaagaacaccgttaatcccatcagcctctcagttaactctggaagcgccaggcgtttgaccaaggccgagcagctttgtgtggacacgattcccctggatggcctgtacagtgaactcgataacaagggcgcgacatacggccccttgttccaggttcaaggtcaagattctcttaagtgctgtgacggcttcagcaatgtagaaattgcagttccggacaccgcttcggtgatgcactcccattacgagacgccatacatcatgcaacctgccttcttggatttgatcttccagcagacctgggccatcttgggagccggccgcaaccgcttgccgagcctttacatgcccaacgttgtcaaatgtctcgagttcagcaaagacttgccgaaccagaatggtgaggcgcttcgcgtggtctgcgagggccatcctgacttcaaaaccctcgcacctgtggatttctccattgatgcgtggcagtctcagggccgtgacgagcctattataagcatcaaaggtttcgtcatgtcacctgttcaagatcaagatatggatgatctgaccccggcatctatctgctataagattcagtgggaggatctcccagaggagagcaagttcggagtcagtgcaagcggcctcagcgtcaacggttcgaaagagcactccagtggcgcgaatggctatgccaacggtgtcaatggtcataccaaattgggtctcactaatggacatgtcaatggtgtcaatggccactcaaatggaatcaatggtactaacggccatgccgacggcgcgaatggccatgccaacggcgcgaatggccatgcgaatggccatgcgaatggctactccaacgggatcgctcacctggaggccgaccttccagctccagtggtgctcgtgaccgacaggagcgaaacagaccccgtcgtcaaggccctttcagatatctttgtcatgaggaccggagtaacgcccactgtgtgcccgttcagacgagtcatgcccgcagagaagatcatggttttccttaatgagcttgatcgtcccttccttgctggaatctccgtcgaagactttgacaaactgcagcgcgtcattctcacgtcaacggctatgctgtgggttaccaagggtatgttcaaggatgcgcaacagcccgagaacgctctgtcccaaggtctcctccggactgtgcgatcggagacgggcaagctcactgcgagcttggacttggatcctcgatcgaagcttgacaaccacgctcgctctgagcttattgtcaaagtcgtgagcaaggtcatgtcatccgatgaagcaaatggtcccagcgattttgagttcgccgaggacaaaggcaagttggtggttcctcgcgtggtggcagactccggcatgaatcaggccgtgcagaggcgcgtccgaagtactggccagtacatgcaaccgtttgaccaaggcgaccgtcgtctggagattgcgattggcacatacggggctctcgactccctctatttccgggaccaggttgttcaaccgctcgaggatgaccaagtcgagatcaaagttacagccactggcatgaacttcaaggatgtggtcattgccatgggacaagtcgccagcagctacctcggtgtcgagtgcagcggcattgtctcccaagtggggagtaaagtcacgacgctctcggtaggcgatcgcgtctgcgctatgtctctgggcgcgtacggaacatatgcgcggtgcaaagagagcagcgctgccgtcgtaccggacgacatggcactcgaagtggccgcctcggtgcccgtggtcttcagcacggcctactatggcatggttgaacttgcccatattcagcctggcgagagcattctcatccacgctgcgtccggtggtgttggacaagcagccattcaacttgctcaaatgctaggcgccgagatttacgcaaccgtcggaagcattgacaagaagaagctgattatggacaagtataaaattcccgaggatcacatcttttacagccgcaatgcaggttttggaccggccattcgtgaagccaccggaggcagaggcgttgatgtcgttcttaactcactcgccggcgagcttttgcgcgagtcctgggaaagccttgcccactttggacgtttcattgagattggcaagcgagatattacgtccaacaccaggctggacatgagtcagtttgagcacaacgtgacgttcagctcagtcgatttgacgctcgtcgccaaagagagaccccaagttatgggccgtgtgctcaagcgggtgatggagcttcttggtagcaagaatatttccgttatcgagccaatcacagtcttgggtatcaccgaactcgaatcggccctgcgtacgttgcagggcggcaagtccacgggaaagatcattatagctccgcgtcccggagagcaagtcaaggcaactcacccacaggaaaaggagatattggttggtaatgccacctatgtcattattggtggtactggaggattgggccgatccatggccaaatggatggtacgacgcggggccaggtcaattgtgctcctgtcgagaagtggtaaagtcacgcctgagttggcacgtcttgtcgaagactgccgagggcagggcgcgacgatcaccatcaagtcctgcgatgtggccaaggaagcaagcgtcaaagaccttgtcgaggactgcggtcggaggatgccaccgatccgcggtatcatacatgcagcgatggttttgcgagacatgctctttgagaaaatgacacacggcgacttcgatcaagtaatcgaggccaaggtgtctggcacatggaacttccatcgagccttggcctctcatcagctcgacttctttgtcgtattgtcgtcggtagctggcatcgtcggaaacagaggccaagcggcatatgcagcggcaaacacattcctggacgcgtttgtccaatacagggttcaacaaggtctgccggctacttcaatcgacctgaccgcagtcgaggacgtcggatacttggcagaaaatgccgagcgtcaaaaccaaattctgcagaatctagctggtagctcttttggcgaggcagaggtccttgccttggttgagcttggcatatctggcgatatctcgcgactctgcaacagccaatgcgtcacgggtctgaactttagtggtgcgtcgttgccgtactacggggaagacgccaggttcctccatctccgcaacgccgttctcgcgacgagtcaaagtgccgatggaatcgacgaatcaggcaagtccaaccaacaggaacttgccagtgccgagacgtacgaaaaggccaacgagtttgtctcgcaacgcgtttgggagaagctgtgcggcatattgatgttgcagcccagcgatctggacccggccagcgaagtcaagtcctatgggctcgactccctgaacgccattgagcttcgaaattggatcggcaaggaatattcggcgcacttgcaagttctcgagcttctcacgtccggaactatcggtgatctggcggccctggttcttaaaaagaccaagatcaaacatccggaaaaggcctcttag

SEQ ID NO: 372 - DNA, 1974 bp, Hirsutella minnesotensis
atgctaacagcgggctcgaatgccagggccttcctagactctcttgatccgtcaaagaaatacgattatgttattgttggttccggggctggaggtgggccgctggctgcgcggctggcaacttacggtcacagcgtcctgctcgtcgatgcaggcgacgatcaaacagacacttatcaatatcaagtaccatctctgaacttgcaggccacggagtacacgccgatgacatgggcattcttcgtcaaccattataacgacccgcagagacaacagcaggataccaaaatgacatggtatactccatctggagaattatatgtcggcaatagtccgccgcagggttcaaccccgtacggaattctatatccgcgagctggaacctttggcggctgtacagctcacaatgcccagattatcgtcttgcccgatgaaggtgactggcagaccatcgtcgatatgaccggagacaagagctgggcgccacataagatgaagaagtactttacgaggctcgagcgaaatcggtatttacctgcgtcacacaagggtcacggctactcaggctggcttacgacaagcgttaccaatctgctcctcgttattccggatcttaaaatcactagcattattctcggtgccgcagcctccgtcggccaaggacttggcaagctagtgactactgcaaaggggttacagcatatatttcttctcgatttgaactcgggcgtgtctgatcgagatcgacggacgggactctttcaaatgccgttgtcaatcaagaatggatatcgctccggcccccgggacttcatcatgcaagtcttagaggaaacggactcagagggccagccgaagcatcaacttgacattcttcttagtgcctttgttaccaaggtcatatttcagaacgccggttatggaaaaccacgagctatcggtgtggagtacgcgaggggtgaaagcatctatcgggctgacccacgagcttccagaaaccggaatcggcctctaagaccaacgggcaatatcactgcgcagcgagaagtgattttgtcaggcggggcgtttaatactccccaaatcctcaagcttagtggtatcggtccggctaccgaattgcaaagatttaacattcccgttgtaaagaatctcccaggagttggaactaatatgcaagatcgatatgaaacgacagtcatcggaaaagctccggaagactttaagttgactaagaagtgcacatggatgaggtccgtccctgacccttgcctagaggattggaagaagaacaagcccatcccacttcgaggcggttacacgaccagcggaatcactctcgctcttcttaagcgctcttccgtctctgcagacgcaacgccggatttgttccttgcaggcgcgccgaccgcgtttacaggttatcaccttgggtattctgatggcggcgtcaaggacgcgctacattggacgtggattgttctcaaagcacacacgagaaactcggctggcaccgtgttgcttcgtaccagggacccgcgggatactccaatcattaccttcaactcctttgacactggaacaaatgacgctcgcgaggcttcgcttgactcgaaggctatggtcgagggcatgctcatggctcgccaagctattaaggatatcccgcatattaagaaaccttttaaagagtcttggcctgcgtctaaagtcaataactcagaacagatgaaggcttgggtcgagcaagaggcttgggggcatcacgcgtcatgcacctgcccaataggaggcgacaacgacccaatggcagtattggactctagcttccgggtgcggggagtcgacggccttcgggtcgttgacgccagtatcttcccaaagattccgggatattttattgtcctgccgatttacatgatttctgagaaggcagctgacgtgatccacgcggacgcgaagagggacaggtaa

SEQ ID NO: 373 - DNA, 678 bp, Mycosphaerella populorum
atggcggcgcgacagagtgcgatgaggcccggcggtggcggtgcgcgctttgcacagtttaagctggtgctcttgggggagtcggctgtgggcaagagttcgctcgtgctgcgattcgtcaaggatcaatttgacgactaccgggaatcgaccatcggcgccgccttcctcacgcaaacaattgcactcgacgagcagactacagtcaagtttgagatttgggacacagcgggacaggagcggtacaagtcgttggcgcccatgtactaccgcaacgccaactgcgctgtagtagtatacgacatcacacaggcagcatcactggacaaggccaaggcgtgggtcaaggagctacaacgacaagcaaacgagaacatcatcatcgcgctcgcaggcaacaaggcagatctggttgccgagcagcctgataaacgtgcagtctcaaccgcagacgcggaagcatatgccaaggaagccaaccttttgttcttcgagacgagtgcaaagacggcagagaacgtcaaggagctatttactgccattgccaagaaactgcctatagagcaggccactcaacgtggcatgaggggtgctgctggaagaccgggcggtgtggaccttggatcaaggcaggacccgggagcatctgctggaggcgcaggggcgtgcaactgctag

SEQ ID NO: 374 - DNA, 2091 bp, Mycosphaerella populorum
atgagtgccacgctgcccttccgcgacatcaatgtacacgcgtcgtcaacctactacgccttttcctcgccctcttcaccgaatgcgccaaccctagtggtcgatcggccatccggagacattcgtctgcacgatggcaaagtcactggaggccaccgcgtttccagcatctctggcatcctcggaatcatcaagctgcgattagatagctatattatagtcatcaccaagtcgcaggccgagggccgattgaaaggacatcaaatttacaaggtcatatccacggagttcctgccattgcgtgaacgccaagtccacgacccggacgaggacacgtatcttgcctacctcaaggctcttctgaagaatggacccatgtacttctcctactccttcgacctcaccaacagcttccagcgacaagcccgccttgatgcaaacgagcccctgtggcaacgtgccgacgatcgcttcttttggaatcgtttcatctctacctctctcatcaatctgcgccagggcaagacagctagccgggtgtcacctggccctcagcctgccgccgatccatatatattgcctgtcatgtatgggatgatgcgcatcaccaacacgtccatcaaaggtaaccccctcacgtttgtactcgtcactcgacgatcacgatttcgcacgggaactcggtacctgtcccggggcattgacgaagacggtcatgtatccaactacaacgagacagaacaagctgttattctcaatgacaccctatctggcggcatgaccagctatgcgggagatcgtggcgtcactagtggagcacccgggagtggctcggagacgcaggtattgtcttatgtccagacacgaggcagtgtgccagtttactgggctgaaatcaactctctcaaatacactcccaaacttcagatccgcggagtcgaaactgctgtgaatgccgcaaagaagcattttgatgaacaaatacaactctatggcgagaactacatggtaaatttggtgaaccagaaaggccgagaaatgcgggtaaaggatgcctatgaacaacttgttaagattctccagtcaaacccaacggagcacacagaagcagatcacagaactcgggtgaagtttgatgtaatcgagcctgacgatcaacggagctggtacgatcacttgcactacgtctatttcgacttccacaacgagaccaagggcctcaagtggcaccgagcacagcttcttctggaccaactggccgacgggctgactgctggcggctattttcatggtatcgatcgaccgtctgggggtgttgatgtccgacggaagcagaccgcggtagtgcgcacgaactgtatggactgtcttgacaggacaaacgtcgtgcaatccatgcttgggcgatggactctcacacgaatgctgatagatcttggcgtgttgcggcctggcgagactgcgcaagacgaccagacgttcgaagatatcttccgcaacgtatgggcagacaatgccgatgtggtttccaaaacctactccggcactggcgcgctcaagactgattttacacgaacaggaaacaggacacgggcaggcatgctacaggatctgaggaacagctgtacacgatatgtgcgcaacaactttgcagatggtcctcgacaagatgcttttgatctcttcttgggtcactattctcccgacaccactggcattggatcactgcagcagtttgcagacaggagacccttggtcatccaagcagtcccatatgtgctcggtttctgtgtcttcttcgttgccgtcagtgtgagcaccaatcggcttcccaactccacggtgtggcctctccgactatttacgctgttcagtttggctgtagcaggttactcgggccgcttcatgtggaaccatgggacactatatgtcaattggccgaaactgaatacacctcaatgggcagtcgaggcttaccaagacacattggaaaaggtcacgaaagatcccctcttgggcgctttcattgctgggggcaatcgtgatgctcgtctaggcacattggaagagggcaagaagcgtcgcgagtaa

SEQ ID NO: 375 - DNA, 204 bp, Mycosphaerella populorum
atgacccacacccgtatggagatttctggcgtgaagatgcacatgcgaatccgtaagcctgaaggcaaatgtcacgagaaatcccacgtgcgaatgtgtcgacttgccaactccgcgttccggttgataggggatcactcaccatgtcgtgtatcagacacagtgatcagacccctcctccgagctgctgcttctgctttctga

SEQ ID NO: 376 - DNA, 804 bp, Mycosphaerella populorum
atgggtacagttgaggccgcacacgtgccattccgcctggatggcaagatcgccctggtgactggctccgggcgaggtattggagcctcgattgcggtcgagctcgctcgccaaggagccaaggtggtggtgaactactctcgagcagcaggaccagccgaaaaagtcgtgcaagagatcaaagccctcggctccgacgccatcgccatcaaagccgacgtcagcaacgtgaacgacaccgtgcgtctcttcgaagaagcagtcgcccactttggaaaactcgacattgtcagctccaacgcaggagtagtttccttcggccacttggaagaagtcactccagaagaattcgaccgcgtgttcaacatcaacactcgaggacaattcttcgtcgctcgcgaaggctacaagcatctcaacaatggtggtcgcattatcttgaccagctctaacactgctcgaggtttcgtggtgcccaagcatgctatctactcgggctccaagggctccattgagtcgtttgtgcccgtcttggccaaggactgcgggagcaaacaaatcactgtcaacgctgtcgctcccggtggtacagtcacggatatgtttcacgatgtggctcatcattacattcctggtggagagaagatgaccattgagcagttgaaggaggccgctgcctatgcctctccactccaccgatgtggctaccctctggatgtcgctcacgccgtgtgtttcctcgcgagcaaagaggcggaatggatcaacggaaaagtgctgccggtggatggtggtgctgcttga

SEQ ID NO: 377 - DNA, 543 bp, Mycosphaerella populorum
atgagtgattgttcttcgctgactgagcttgcagatgtcatgggctgccaggccgcgttgtttgaatgggcagacagctacgatgcgaaggattgggcacgactgcgcgaatgcgtagcaccaagcctcatggtcgactaccgggcgttcctcaacaagaagtgggatgacatgccggcggacgagtttgtgcagatggcgtccgactctcatttcctgggcaacaagacgatcaagacacagcattttcacggcggcagtcgatatgagcaggagtcggacgacaagatcatcggacaccaccagatgcgcgtggcacaccaaaagtacgccgacgagtccctgcagacggtggtcgccaaaggccatggccacggcacggcgaccatttggtacaagaaggtggacggcgtgtggaagtttgccggtttgattcccaacacgcgatggacagaatatgatttccacaagatttttggcggtcatcacgacgctgatgctgagagcggtggcgagtcttcaggaaccgcatcgccggcgtag

SEQ ID NO: 378 - DNA, 5364 bp, Mycosphaerella populorum
atggaaatcatttatttcagcaacgagttcccccgtgatgacctgcagggtgtgctgcgcaagttgcacaaccattccaaagaccgtcgtcacaccgtcttggcgcagttcatcgcagacgctactcgtagcgtcaaggaggaaatccgaactcttcccaaggccctcaaggcctgcttcaagcccttctcgactctattccaatgggccgaggatacggagctgcgcgaagggcccttgaatggcgccgtggacggtgtgctgctgtccgtactccagctggccacgtacattggatatgcagaagagcacccggacgaactcttcaacttcggcaacacgtgcttgaccggtctcggtctaggcctgatctcgtccactgccgtcgctctctcgccgaccttggccgaacttccccttgctggtgccgatgcggtgcgtctggcgttccgtatgggcatcctcgtcaccgacatctccgctgatctcgaggcgcgagtggaaggcgagtcaccagactcgtgggcttatgtcgtccacaacgtcgagcccgacgaggcccaacatcaacttgacctgttcaacttcaaggaacgtctcccagagacgggcaagatctccctgagcgcatacagccgcacatccgtcactgtcagcggcccaccggcccgactcaaggaactcttcaagaagtcgcagtactatcgcgatgcccgatccatcgctctgcccgtgtttggcggtctctgccacgctcctcacatctacgaccgcagccatgctcagcgtattgtgcgagaagcgacgttgaactgcaacgagggcaagcgattgcttcccatgactcccgtctactgcacaagcaccggcaagccatacgtcgcacaagatgcgctcgagctgctcgagaatgtcatcctggagcctctgacccagcccatcatctgggaccatgtcatcagtggcatcgtggatcgtgccaccgccacctgcgcccagacctgcaccatctacagctttggcccatccatcccgctcaaggagctgacggagagtatgggcgcgcgcattaccgaattcaacaccgactctgtcaacatcatgggatggatcaacgagagcactcccgatgagctcaactcccgtggcagcgcccaagcaaagctggccattgtgggcatgtcgtgcagactccccggcggtgctaccagcaccgaaaagttttgggaagttctggagaaaggactcgatgtttctcggaagattcccgccgatcgcttcgacatcgacacgcactacgaccctactggtaaacagctcaacaagagcatgacccagtacatgtgcgcgattgatgagcccggcctctttgatgccccattcttcaacatgtccccacgcgaggcgcaagtcgtggaccctcagatgcggttggcacttgtcactgcgtacgaagccctcgagcgtgcgggctatgtggccaaccgtactgcttcgacgctgctgcagcgcatcggcacctggtacggacaagccgccgacgactaccgagaagtgaaccaaggtcaagaggtcagcacctactacattccaggaggctgccgagcatttggtcccggacgtatcaactactacttcaagtttgcagggcccagctattccgtcgacactgcttgttcctctggattggctgccattgaagttgcctgccaggctctgtggaatggcgaggtcgacaccgcagtgaccggcggcatgaacatcttgaccaaccccgatggtttcgctggtctcaattgcggccacttcctcaccaagacccacaacgcatgcaagacctgggatgctactgctgatggctactgccgagcagacggcattggctctctggtcatcaagagactcgaagacgccgaggccgacaacgacaacatcttgggtgtcatcctcggcgctggaaccaaccactctgcggaagcagtctccatcacccaccctcatgccggccaccaagcctatctggcccgacaggtccttcgacaagcaggtgtggaccctcttgatgtatcgtacgtcgagcttcacggaacgggcacccaggcaggagaccacgaggagatgcaaggcatcatggaagtctatgcgccactctctggccgtcgctccaagaaccagcccttgtacattggcgcgtccaaggcgaacgtgggtcacggagagtctgtcgccggcaccacagcactcatcaagaccctgctcatgctccaaaagaatgccattccacctcatgtgggtatcaagactgagatcaaccccaggtttccaaaggatttcgacaagcgcaacctccacatcgctttcgagaagactacctggccacagcaccctggtaagaagcgaatcgctgccatcaacaactttggtgctgcgggaggcaacaccacgatggtattggaggaggctccagctcgtgtgcctgcggaggccgacacccgccagctgcatgttgtagctgtgtcggccaagaacaagacatctctggctggaaatctcgaaaggctccaggcctggatcgaaaacaacccagaagtgagccttgccgacctgtcgtacacgacgaccgctagacgccagcaccacaaccaccgtgtggccattgccgccactgacctcaagggtctccaaaaagagctcgcaaagaagctggcagccgccgactcacaccaaccaatccccaagtcgggcgcgccaccagtggccttctgcttcacagggcaaggtgctgcgtacaagtccatggacttggagctgtaccgtgaagtcccatcattcaggtccgacttcaaccacttcgactctcttgcacaacgtcaaggcttcccttccatcatccctgcggtcgatggatctttccccaaggaacacgcacactctcctgtcgtcacgcagctttcgcaagtgtgcatgcagatggcactggccaagtactgggcatctttggggatcaagcccgatatggtattgggccacagcctcggcgagtatgccgccatgtatgtggcgggcgtcttgtctgccaacgacaccatctatctcgttggtaagcgggcgcaactgctggaagcgaacgctcgtgtcggcagccaccaaatgatggccgtgcgtgcgtctctcgcacagatcaaagaagcggatggtggcctgcagtacgaggtggcttgcgtcaacggtccttcagacaccgtgctgagcggtaccgtcgagcagatggatgctgtatcggcacctttgggtgcggcaggctacaaatgcatcaagctcgacgtcgccttcgccttccactctgcgcagatggaccccatcctggacgagttcgaggagattgcaaggaccggtgttgttttcaaggagcccatcgtgcctgtcatctcgcctctccacggcaaggtgattttcgatggcaagacattgaacgccaaatactgccgtgatgccacccgcggcactgtcaacttcttgggtgcgctggagagtgcccaagaaatctccaccatcacggaggacacggtctacgtcgagatcggcgctcaccccgtctgctgcagcttcgtcaagtccagcattccagccctcaacttggctgtcccatcattccgccgcggcgagagcaactggacaacgattgcgcaggcatgtactgcaattcacctcgctggcctcgacgtcgactggaactcctaccacgctccattggagaagagcctaacgctgctggacctgcccacatatgcctggaatgaaaagacgtactggctccagtacaacggcgattgggcgctcaccaaaggtaacaccttctacactgccgagaaggaggccgccgcaaaggccgcagccgctactgggtcggtgcgttccaacgccgccagccccatcaagacatccactgtccagaacatcatcgaagagcacttccaggacgtggctggtaccgttgttatggagtccgatttgatgcaggccgacttcctcgccgcggctcatggccacaagatgaacggatgtggtgtggtgacatcgtccatccatgccgacattgcatacactctcggagagtacttctacaagaagctcaacaagaaagccaaaaaggtggacatgaatgtggccaacttgtatgtcagcaaaggcttggtggccaatgccaacaccaagaacccacagtgtattcgcgtcactgtgactacagaggacatccgcaccaacgtcgccaacctgtattggcagaacgtggatgcagatggtaacgcggcggatgtgttcgcggaggcgaatctcgtctttggtgatgccaccgagtggctcagcacatgggcacccatgacccatttggtgcaaggccgtatcgatgccctcgatgctcaagcgagggcaggtaaggcgactcgtctgtcacacaacatggcctacacgctcttcggcaagaaccttgtggactaccaccacaagtaccgtggcatgcaagccgtgacgatgaatgagctcgaagcttacgccgacgtggagctcaccaccgagaagggtggcgtatggactgttcccccatactttattgacagcgttgctcatcttgctggcttcatcatgaactgctccgacgccatcgacacgcagaacaactactgcgtcactcccggctggaaggcgatgcagtttgcgaagccacttactcccggtgccaagtactgctcgtacgtgaagatgatcccgaccgtcgaggacccgaccgtctatttcggcgatgtgtacatccttcaagacggcgtcatcgtgggcatggttggcggcatccagttccgtcgcttcccaagaatattgctgaacaaattcttctctccaccggacaagtctgagcccatctctgcaaacaagagcgctgctccactacccaagcctgccgcacttcctgttgcagcgcctgtcagcaagccaacacccagtgcgccagctgcgccaccgatggtacgagttgactcgggcactggttcagagccagaaaagaccaaggaggctgcgccagcgccagcaccagcaccagcaccagcagtggagactgctgccgacaccgctaccgacacctcttctgtcacatacaaggcgctcgagctcatcgccaacgaggccgcgctcgaaatatccgacctcgaagatgacgttagctttgctgctctgggcattgactctctcatgtcgctggtgatatcggaaaagttccgcagcgagctcgatatcaaggtcggtggaagcatgttcttggattacccaaccattggagacctcaaggcgtacaccgatacgttgtaa

SEQ ID NO: 379 - DNA, 1011 bp, Mycosphaerella populorum
atggaggacgacaagggaggctaccgccaaatcaacaagtcgttgaacatttgcgcgtttgaggactatctgcagggtcaaacagcgcgtctgccgcagttggccgatgtcgagcaattgacgccgcgggtgcttcgcattttgggtcagaaccccggacgattcaccttccagggcaccaacacatatgtgatcggaacgggccatacacggctcctcatcgacacgggcggcggcgaaccggagtgggccgaattgatcgccaagacactcgagtccatggacattaagctttcgcatgtgcttctcacgcactggcacggcgatcacaccggcggcgttccgaatctcctccttcgctacccggacctccacgacgccatttacaaacacactcccgacccgggccaacaacccatccttcactcgcagcgcttctgcgtgcaaggcgctaccgtccgcgccgtgcacacgcccggccattcggaagatcacgtgtgttttgtgctcgaggaagagaatgccatgtttacgggcgataacgtcttgggaacgggcaccagcgccgtcgaagatttgggcatttttatggattctttgcacattatgcgcgatcaaaactgccaagtcggtcattccgctcatggcgctgtcattcaagatttaccggccaaattgaaccaggaaattgcgggcaaattgcgtcgtgaacgacaggtgttgcagacgttgaataaagtcaagacttcgggtgaaaagagtgtcacggtcaaggatttggtcttgaaaatgtatggtgacaatgtcgatccggccacgagggaattggccttggagccgttcatggatgaggtgttgcgcaagttggccggtgatggcaaggttgcctttgagaaacgggcgggtatcaagaagtggttttcgttggctaagcctgctcaggctgctgctactccacaccctgctaaggctggcggtttgaagcctttgactgctattcgcgcttgttag

SEQ ID NO: 380 - DNA, 807 bp, Mycosphaerella populorum
atggcagaatccgctcctgtcgatggcttgtccacgcccagaattaccactttcgccatcatgggctgcacgggaaacacgggcactgccatcattcagcatttgctcgacacacccaatgtcaagattaacgcctactgtcgaaacaaggccaagctgttcaacgccatgcctgccacgagggagaacaagaaggtcgaggtgttcgaaggcagtattcaggacgtggacctgctggcccgttgtatgcagggagcaagagcggtcttccttctcgccagcacaaacgacaatgtccccggatgtcgcatcagccaggacctctctctggcgacagtgacggcactgaaaaagctcaaagcagattctgactccttccagcctcccaagctggtgttactgtcttccgccaccgtcgacgactacctcagccgcaaaattccctacttccggcccatcatgctccgcgccgcttcgaacgtgtacgaggatctgcgacgcaccgagacgtttctgcgagcgcaggaagattggctgacgaccatttacatcaaaccgggaggcttatccaaggacattggaagaggtcacaagctcactttgcacgacgaagagaccttcctctcctacgtggatctggcggcgggcatgattgaagccgcgagcgacacttccgatcagtgggatgggaaaaatgtgggcgtcatcaatgcgggcagaaaggccaagtttgaaaggagtacaccagcgaccatcttttttggcctcattcgccactatttccccttcttgcacccatatcttcca

SEQ ID NO: 381 - DNA, 4395 bp, Pseudogymnoascus pannorum
atggcgcccagtgccgtctctcccacgccggcctcccccgccgaggcatccacacacctcgccgaggtgaccgccttctacgacacaaccctgcggtttttcctcaacggtactcgcgttaacctcgacaatatcgaccccgagattaccctcctcgagtacctccgcggcatcgggctcaccggcaccaagcttggctgctctgaaggcggctgtggcgcgtgcaccgttgtcgttagccagtggaatcccaccaccaagaagatctaccacgccagcgttaatgcgtgtctggcaccgctcgtgagtgtggatggcaaacatgtcattacagtggagggaatcggaaatgtagaaaagccacatagtgtgcaggagcgcattgcgaaggggaatggaagtcagtgcgggttctgcacgccgggtattgtgatgagtctctacgcgctgctgcggaacgaagatcaacccactgagcattccatcgaggaagcctttgacggtaacctatgtcgatgcacagggtataggcctatcctggaagcggcgcgtacattcagcgctgagactggttgtgcgaaggccaagaccaacggcggtggaggatgctgcatggagaaggaaggaggtggcggctgctgccagagcaagcccgcagacgacgaccagccgataaagcgtttcacgccgcctgggttcatcgagtacaaccctgacactcaactcatcttcccacctgcactcaccaaatacgagttcaagccgttgacgttcggaaacaagcggaagcgctggtaccgccccgtcactgttgaccaactgctgcgtatcaagaacgcgatgccgtcagccaagattattggtggcagcagtgagactcagatcgagatcaagtttaaggctatgcaatactcggcatccgtatttgttggggatatcccggaactgcgcaagtttgagttccacgacgaccacctagagattggaggcaacatcacgctgacggatctggaagccattacgctgaaggctgttgagcactatggcccagataagggacaggtgtttacgaatatgcataggcaacttcagttctttgccggaaggcagattaggaatgttgggacgccggcgggtaatctggcgacggctagtccgatcagtgatctgaacccggtgcttgtcgctgcaaatgccacattggtggcgaagacgcttgaagaaactacggatatccccatgacggagtttttcaagtcatatcgtactactgcactcccagcgggggcgatcatcgctagtcttcggattcctgtcacggcgacgaacgagtataccagcgcgtataagcaggcgaagaggaaggatgatgatattgccatcgtcactgctgccctgcgagtaaaactcagcgagaaccacgatgtagagagtgtcaacctcgtctacggtggaatggctcccctcaccatctcagcgaagaaagcagacgctttcctcgttggcaagaagtggaccgatccggccacgctcgaaggcgtcatgggtgctctcgaacaagacttcgatctcaagttcggcgtccccggtggcatggccacctaccgcaagaccctcgcactcagcttcttctaccgcttctatcacgaggtgctcatcaagctcggtgataaagccgcggatcttgaggccgttggcgagattgagcgtgagatctcccgcggcgagcaggaccacgacgccactgctgcgtatgagaaaatgattatgggtcgcgcgcaaccgcacgttgctgcgctgaagcaatgtacgggacaagcgcagtacacggatgatatcccggtgcagaggaacgagctgtacggatgtctggttctttcgaccaaggcgagggcgaagctcatatccgttgatacatcagcggcgctggagttaccaggtgtagtagattacctcgaccatacagatatgccgagtccagaggcaaattggtggggtgcccccgtaagggatgaggtattctttgctgtgaatgaagtcttcacttgtggtcagcctattggtgtcattctcgccagtacagcaaacgaggctgctgcaggtgcgagagcagtcaagatccagtatgaagaactgcctgctatatacaccattgaggaggctatcgagaaggagagttactttgagcagtttcggttcattaagactggagatacagagaaggcgttcgcggaagcggaccatgtaatctcaggcacaacgaggatgggaggccaggagcatttttaccttgaaaccaatgcttgcgttgctattccgaagcccgaagatggtgagatggaggtgtttgcttgtacgcaaaaccccacagagacgcaagcatatgctgcgcaagtctgcggtgttgccaacaacaaggtcgtctgccgagtcaagcgtctcggaggtggctttggtggcaaggaaactcgttcagtgcagctgagctctatcatggcgctcgcggcgaagaaaacaggccgcccagtgcgctgcatgctcaaccgcgacgaggacatgatgacaagcggccagcgccaccccttcctcacgaaatggaagattgccatcaacagcgatggcaagcttcaggccctcgatgccgaggtagtctgcaacggaggctggactcaagatctcagcggtgcagtctgcgagcgcgcactctcccacattgatggctgctacgctatcccgaacgtccacgttcgtggccgtattgcacgcactaacaccatgtccaactctgctttccgcggcttcggtggaccccaaggtctcttcgttgcagaaacatatatggaagaggcggcggaccgacttggaatcccagcagagaagctgcgcgagatcaacctctacaagcccatggagatcacgcacttcaaccaggctctgcaggactggcatatccctctcatgtacgaccaagttcgcaagaattccaagtacgaggagcgccgcgtcgctgtggatgagttcaatgccacccacaagtggcgtaagcgtggacttgccattgtcccaactaaattcggtatctcattcaccgcactcttcctcaatcaggctggtgccctcgtacacatctaccacgacggttcggtgctgctcgcccacggtggcactgaaatgggacagggcctgcacaccaagatgtgcatgattgctgcggagactctcggcgttccactggactccgtccatatctccgaaacaggcaccaacaccgttgccaacacttcttccacagctgccagtgcctctagcgatctcaacggctatgccatctacaacgcctgcgcccagctcaacgagcgtctcgcacccttcaagacccagcttggccccgaggccaccatggctcagctcgcccacgccgcatatttctctcgagtcaatctctccgcacagggctactatcgcacacccgaaatcggttacacatggggcaagaacgagggcaagatgttcttctacttcacccagggtgttgctgcggcggaagtcgagattgacacccttactggcgcatggacatgcatccgcgccgacgtgctcatggacgtcggccgtagtatcaatccctccgtcgactacgggcaggtcgaaggtgcttttgtgcagggcgtcgggctcttcacgatggaggagtccctgtggttcggaggcggtccgatggcaggacaactcgcgacccgtggtccgggtaattacaagatcccaggctttagagacgtgccgcaggtgttcaatgttagcctgttgaagggagtagagtggaaagagttgaggactattggcaggagtaggggtgtgggagaaccaccactattcttgggaagtgtggtcttctttgccattagggatgccattcgggctgggaggaagcaatggggcgttgaggcgaagaggtttgtgccgagagggctgcgaggtgcggcgacgaatggagatggaagcgcggatgctgtggaagtaaccaacggcgaatcaacaaacggagaagcaaccaatggtcacgccacggatggggaggccaccaacggtgatgtagcaaatggtgaagtagccaacggcgaaaccaccaacggagagtcagatgaatctgtggccacaagcgagccaagcagcgtttcagaagacaccacagccaccaccccagatacggcctctgacgccgatgcggtacaaccacaggaccaggaaccaccagcagaggcggaagacggcatgctgtatctcgatagccctgcgacgacagagcgtatcaggaacgcatgtgtggatcctattgtgcagcgcgcgagggtgaagcaaggggagggggacaagccgttctttatttcgatttaa

SEQ ID NO: 382 - DNA, 966 bp, Pseudogymnoascus pannorum
atgacttttcatcctgacactctccccgatctcaagggcaaagtattcatagttacgggtggaaattccggcataggctactataccgtggcccatttagcaggacacggggcccacgtttacatgtgcgcccgatccacggagaagggtacagcagccatcgccagtatcaaaaaaatgcacccttcagccaacattgacctcctgcgaatggacctcatggatcttaccagcgttgttgcggctgccaagcacttcctcgccctcgaaacagccttgcacggcctggttaacaacgcaggtatcatggcgacgcccttcgaaatgaccaaagatggctacgaggcccagtggcagaccaactaccttgctcattggatttttacggatcgtctgcttcctctgctgcgacgaaccgcgaagacacttcctcccggtggcgtgcgcatcgtcaacctcacttcatcaggccacttgagcgcacccaaggctggcatcaatttcgaagacctatcgctcaaggacggtggcccctggcagaggtacggacagagcaaactcggcaacattctgcacgctaggaccttgcacaagatgtacggccccggctctcccagtgcgcgcaatggcgagggcgaaatatgggttatgtccgtgcatccaggtgtggttgagacgaacctcgcagcatcagtggggggatcaggatcagtcatgtccactattttctctatatcaatctcggcattacgcatgtttggattgatgtatcctgccgataaggggtcgtggacaagtttgttcggcgtggcgagtcgggatatgaaggcggagcagagtggcacgtattttgaagtcttcgggcggtttgcggagccgaaatggcagagcagcgcggccaaggatgcgaagcttgcagagagattggagaagtggacaagggaggtgataattggggagttctag

SEQ ID NO: 383 - DNA, 915 bp, Pseudogymnoascus pannorum
atgggtagtgcgtatgaacctgtaaatccaacagcaccatgctaccaactcgcgtcgatgccacaattggccgaggccataagcaaggaagatgactggactgggaccaaggatgctgcggcacgccgacgggcacagactagacttaacacaagggcatacagaaaacgcaaagccgcagccgcagccaggatgccgattaattcagatgcacaagtggaatgctgggacatcaagaagcaattcgtctccgttgtcccggcctcccgagccaagcaactatacgatgcgagaaatcccctgcttccagataaatttagtaaagcgcagtttaacattgtattccccctttgtccagaccacctcatcacactcctccaattcaactccctccgcgccatggctgtcaacagaactctaatctcgggcgtccttgtcacgccgctcgactgtggcgaggaaattatccacgtcgttccctaccctaccaagcctgaactactccctccgacacttctacctaccattcttcaacaaacggtgccgcatggtgactggatcgacatgtttccatgccctgaggtacgagacagcctaatccgcgcagccggcatgattgacgaggacgacttgtgggctgactgcattggtggactatatgaggggtttcccgacgatgagattgagcgacgcggcctcattgcgtggtcgccgccctgggacatcgctgggtgggagatgtcggaagggtttttgaggaaatggggtactgcaatagtatatcgagcatctatgatattaagagcaagtaacagggtgctgcaaacttatcttgtccacgttaatggtggtggagctgagcttccttccgaaaaccttttgacctacacgacaaatagttttttgttgggctaa

SEQ ID NO: 384 - DNA, 1524 bp, Pseudogymnoascus pannorum
atgttagacttggaatccgacacgcaagttggccggacgcgtaatcaggtgtcgtcacggtcaaaacttcgcgacagctgccatgcctgtgctatatcgaaggtcaaatgccccaaagagaagccatcatgttcaaaatgcgaattccgtggcatcacatgtcagtacttcctagctaaacgtcccggacgcaggcgtgagaacgcaaccaacagcacagggaatagcacaggtcaatgcctgtccaacagaaaccttgggactaagtccagctcaagttcaaaccccaacattagagccaatgttgatagtagtcattctatggagtgggatgcatttcgagatactcaatctactcctggggtcggcttgttctctaaaggcggcacaataattgcagctaattcgtatggagccgacagctaccttacgacaccattatctttgagcgtgccatcatctccaaggcaagacaatgcgttcacgactaatgcagcccgatatttcgtgcctggagaggcaagcattttctcggggctggcagacttcggctctgaggccaacgacatggacttcatcatgtcagccatggactctccgtttgacctaattggaatggacagtggtagtattaccggaagcactactcagacaccaaatgatattgagtcgcttctcatgccagctgagaggatcaatcttgacaatgcctcattagacacgccatcatcgcttgatctacttagtacatcgagtggggcttcatcgcacttatccaaagcccattcgctatcgactggaaggactagtatggcagaaatcactgatacgcaatgtggatgtttggcacaagctctagatttattgaagaagctgtcatccgcgtcgagctcctctcgagtcactttttttagtcctgatggtggcgaggcgcctagaataaccgatcctggatcaacgcagaccgtcatcttggagaataagcaaagcatggaagctattagccacaagcttgcgtgttgttcatgcgccgatgaccgtttcttgctgaccatcctctctatgatcattctaaaggtattagaacgatacgcagctgtgatacagacacagccccacaaggcaggaaagaatgagggggaagttgaagtggcagccaggataccgatcagcgttatctctagcggcgacgactggatgtgggcgccgagccatgcctacaacgaattgcatgcggactgtggcagtgggcgtgtggctgctcagcttgttctcagtgagctgcaccgcgtgcagaggttagtaaaccaactttccccaaagctcaaaggaccaaaggagagagaaaaccaaaatatggccccgaatctgcgatactggggccgagccagagccacagcagatagcgataggatggccgtaacgcctatattggcgagtaccttggaccaaatggaaagagacgttcgcaagagccttagtactctgtctgcggagattatcaatgggttacggcaacgttaa

SEQ ID NO: 385 - DNA, 1347 bp, Pseudogymnoascus pannorum
atggatagattgacagaactcaacgaccattgcgagcaactcgccacagcggtcaaaagcctcgccgataaccttccaggcgctgactcttccgatcagctggggacaaatgctgatgccgatacggacaaagatcaaactttacccaacagacctaagtcaagtatcctggccagtattgtagcaatcaaagctctggtcagcggacctacggacttcctccaggattttgctcgccagattcaaatccttgcctgtattcagtggctggcagaatttcaagttttggcatgcatcccgttcgatgaaagtttgcctatcaaagatttggccgacttggtaggagttccggaggggcagctggttcgggtcatccgtctaacagccacatgcggatttctacgggagcaaacaactggctttgtatcccacagccctctctcggcacaatttataaccaatcagttgttacttgatgctacggtgtttattgctgagatggctacccctacagcattgcagatgccgcatgcaacgcagcgcttcggggcttcgacaaattcctcagagagtgcattcaacctagcgctgaacacggtacggccatttcatgtagctattcaggagcgccctaaactgcgtcgacagtggtcagcttatctttgtcatgcagtggggttacaccaagaggaggaaatagtggaagtgctgtcgcggctcaactgggcaaaccttggcaacgcatgcatagttgaagtaggcgcaaaatcatcctcgatggcaaattctctttctagaaggttcccaagcttgcgcttggttgtgcaagttgataatacgcagtcttctttgctagatcaagactgtatgctgcaaagctcggggctaggaagctctattcaagacagctctagctctgggtctagtccttcttccacaaaccaatttgtcgccgttacatattgtgccatgagcatggctcagtccataacagatgctgccgtctatattcttcatgtacccacggcatcctcgggactaaccattagagcggtactggatgattacttaggcgtgcttcgtgccagtggcggtatcatgattgttttgacagcacgtctacttcctgagccaggtagcctttccaatcctgaggtcgaggcagtggcacgcgcacgagaccttagcgtacttcatctagccaacgatagcgagatggaaatgtctgagctagtgagcatcataaaaactgtgggagatggcgctgggaaacttgtcattaccaattatcttcggtcaaaccacggcgtcattctagccttgactattaagtgccaggcttattaa

SEQ ID NO: 386 - DNA, 1002 bp, Pseudogymnoascus pannorum
atgaaaaatgacaagggcggttacaggcaaattaataagtcgctgaatatctacgccttcgatgactaccttaaaggacagaccgcacggctgccccaccttgagagcgttgaacagctcaccccgagggtgcttcgcattcttggccagaaccctggaaaatttacgtatcaagggactaatacatacattgttggcactggtcaacaccgactcatcatcgacactggtggtggcggtccggcatgggctgagctgattgcttccacgtttacatcaatgaacattaccctatcttatgtgctgctaactcattggcacggtgatcatactggcggtgttccaagtctactacgtctatatccgcatctcacggattccgtctacaagaacgaacaggaacaaggccagcagaacctcacaaacgggcagatattcgtcgttgatggtgcaacaattcgtgccattcatgcacctggacattcagaagaccatatgtgttttatactagaagaggagcaggccatgtttaccggcgataatatccttggtcatggtaccagtgccgtagaagacctaggcacctttatggctagtctgcagaatatggccagccagggttgttatatcggttattctgcccatggggcaacaattaccaacttgccagctaaaattgcgggagaattaggtaacaagtggcggcgcgagaaacaagtctcagaggggcttggccgagttcgtagtcggggcgagaagagcgttactgttaaggatcttgttactgaaatctacggagattcgttagatgaagatgtgaggatgctcgcactagagccgtttactgacgaagtgctgcggaagttggcggatgatggcaaggttgccttcgaaattagaggcggcaaaaagaagtggttctctgtggaagaggcacagcaggcaacagttcggcggttttcacctgtggaaacttcactagctgtaactattcaagtttaa

SEQ ID NO: 387 - DNA, 5340 bp, Pseudogymnoascus pannorum
atggaaattgtctattttagcaatgaactccccaaaaatgacttgcaagacgttttccgccgcctgcataaccacagcaaggacaagcatttttcggtcttggaccaattcatacacgaggccacctcggccgtcaaggatgaagttcgccaactaccaactaagctgaaacagctaattcaaccatttaataccattatggcatgggcggaagatacccagctccgagaaggcccaatctgtttcgccgtggacggagtgttacttgtcgttgtccaactggcaacttacattggatacattgaaagtcgccctggagatttatttgacttttcaactacgtctcttgctggcctaggcactggcctattatcatcgagtgccatctcattgtcgccaacattggccgacttgccactggcaggcgcagatgccgtccgcctggcatttcgcttgggaatccatgttatgggtatctcagaaactctagaagcccgcgatgtgtcagaaaacccagaatcgtgggcgtatgtggttcaaaatgtcgacccagcaacggctcagagagaactagataccatccactccagagtcgagatacctaatactagcagaatatttataagcgctgtcagtcggacttcagtcacagtgagcgggccgccatcaaggttaaaagcgctgttcaataagtcagaattcttccgcgtgtccaaggtgattgaattgccagtgtacggcggcatctgccatgcaccccatgtattcggcctgcgggatgtacataaggtcgttcatggctgttcattaaacgccgctactacgaattctccaccggtgatgccagttttatcgacaggtagcggcctgccgtacctggccaataattcagtggagatgttcgaatgtgtcatctcagagctctttacgaaaacaatatattgggataatgttgtcagttacattgtcgaccgagtaaagtctaccgctattacggaaactgtgcttcactgcttcgggaactctacacccctcaatgatatcgatgtggccctaaagagcaatgtcccaaatcttgacgtctcaattaacagtctcatgccatggatctttcaagttgcaccaagagatggtacaccccgcggcactgcacaatctaagctggccattatcggtatgtcctgcagacttccggggggtgccacagataccgagaagttttgggaaattttagagaaagggcttgatgtctcacgacgaattccagctgaccgcttcgacatcgacgcacactacgacccaactggcaagcagcaaaacaagaccatgacacagtatggatgcttcattgatgagcctggattatttgacgcacccttcttcaacatgtccccccgtgaatctcagactgtcgatccgcagatgcgtctagctcttgtcactgcatacgaggcactggagcgtgctgggtatgttggcaaccgtacagcttccacacagttgcaacgtattggaacttattatggacaagctgccgatgattaccgtgaagtcaaccaaggccaagagattggcacatactacattcctggcggttgccgcgcattcggccctggtcgtatcaattacttttttaaatttgcgggtcccagctacagcattgacactgcctgctcttctggtcttgcagcgattgagctcgcgtgtcaggctctttggagtggtgatgtcgatatggtcgttactggcggtgtaaatgttttgaccaaccccgattgtttcactgggctatgcaatggccattttctaactaaaggtcacaacgcgtgcaagacttgggattctaccgctgatgggtactgtcgtgcggacggcattggatctcttgttattaagaaacttgaagatgctgaagcagacaacgacaacgtcttaggcgttattcttggtgcaggaaccaaccattctgctgaggctgtctctatcacgcacccccacgctggccatcaagcatacctatcccgccaggttcttcgccaggctggtgtagatcccttagatgtatcctatattgagctccatggcactggtactcaagctggtgaccatgaggagatgcagggcattatggaggtttatgctccgcttatcaagcgacgtatgaaggatcagcctcttcacattggtgctgtaaaagcaaacgttggccatggtgagtctgttgcgggtacaacagcactgattaaagtgcttctgatgctacagaaaaactctattccaccacatattgggatcaaaacggagatgaaccctaggttcccccaagactttgacaaacgaaatctccatatcaacttagagatggcacaatggccccgagttccgcctaagaagcgtcttgcagttgttaacaactttggtgctgctggcggaaacacgactatggttttagaagaggcaccgactcgtgtcatatcggatgctgacccacgcgatactcacatcatcgctatctcagccaagactaaagggtcgttaataggaaatatcgagcgcttgattgcccatcttgatgcgcacccagatataaatctcgccgacctttcatacacgacaacggcacgtcgttaccaccacgccaaccgcgtggcagtagctacttccgatgtaggtcacctgaagaagcagctggcttcccgcctagagaatctcgattcactgaagcctgtgggaaattctggcccgccaccaattgcttttgccttcactggccagggctcttcttacaagtctatgaacctcgagttgtaccgagacgtaccaacattccgagagcatattcaatatcttgactccctcgctcgaagtcaaggctttccatctattgttcccgctctcgatggatcccatcctaaagaccacgcacactcgccagtcgttactcagcttgccctagtctgcactgagattgctttagcaaagtattgggcttctctcggcgttaaaccagatgtagtaattggacatagcctgggcgaatatgctgcgatgcacatagctggtgtggttaccgcaagcgacaccatattcatggttggacgtcgagctcagatgttagaagaaaagtgcaagattaatagtcataatatgatagctgttcgagcttctcttcagcaaataacagagggattgggagaaaagccgcatacaattgcttgcattaatggaccttctgatactgtgctcagcggcaccaaggagcagatggaagaggttgccgtgttactagaggcggtcggctaccgttgctttaagctagatgtcgctttcgctttccactcggagcagactgatccaattttagatgcctttgaggcaatttcaaagactggcgttctttttcagggaccaaaactgccagtaatttctccattgctcggaaaggtcgtttttgatagcaagacgcttaacgcaaactatgttagccgcgccactagagagcctgtcgacttcttgtctgctttgaaaaatgcccaaaagatttctactattagcgatgacaccatttggatcgaaattggaccacatccagtctgtactaactttgtcaaaaccacaatcccgtctacgaagcttgctatcccatcgatccgccgtggagaagacaactggaaaactatggctgagagcatggctgctctgcatcttgctggatttgcagtcagttggaatgaattccaccgcccacttgagtctaagctacgccttctagatttgccaacatacgcctggaatgacaagaactactggattcaatacaatggcgactggtgtctgaccaagggcaataagttttacgatgctgaaaaggaggctgccagagtaaacaaactgacaaaggcactacctgcgagcaagattcaaacgacgactgtgcagcagattatagatgagacttttaacggtttcgcaggcacagtggtaatacagtcagaccttatgcaagtagacttgcttgctgctgctcatggacacagcatgaacaattatggtgttgttacatcttctattcacgccgacctctcatacacccttggcgactatctctaccgcaagttatgccccaacgctaaggatgtcaacatgaattttgtcaacttggttgttacaaagggtcttgttgctcaaaccagtaacaagactccccaattgttccgggttactgcggtcacttccgatgtccgctcaggcgtggtcgacttgacgtggcagaatgtggacaacgatggcaatgtccacgagccatttgcaaccgccggtatactgtacggggatgcatctgagtggatcttgtcttgggccccattttctcacctcatccacggccgcattgaagcactcgagcacctagctgccgaaggaaaagctagccgcttttcgcgtaacatggcatacacactatttgctagcaaccttgtcgactacgccgagaagtaccgtggcatgcagtccgtagttatacatgggctagaagggtttgctgatgtgcaactaactacaaaggagggtggagtttggacagtccctccatatttcatcgacagcgtggtgcatttggctggttttattatgaactgctccgatgcaatggatgcgaagaacaactactgtgttactcccggttggaactcgatgcgattcgcaaagcctttggttcccggggccaagtatcgttcgtacgtcaaaatgattcccacagtcgaggactcaacgatttattttggcgatgtatacatcatgcaagacaatgttataatgggtatggtcagcggcatgcagttccgcagatacccgcgcatcctcctcggccgatttttctcgccaccggacaagatggccgcctatgaaggcaagccaaaggggcaaaccagtgtccctaaaattgcaacttcagcgccagatgcaacaaaaattattgcacccgaccgtgaacctagacttggcagtgacgacaagcacagtgaacatattcttcctgattcccctaccattgcgccgcctgtccccaatgccgcggcaccacctgtcgtcgaatctgcagccgcttctgacagtacaactgcaaaggcaatcatgctcattgctaatgaggccagtctagaactctccgatatggaagacgatgcccttttcgtcaatttaggcatcgacagcttgatgtcactggtaattgcagaaaagctgaggtcggagctggatgttaaggtaagcggtagtcttttcttggactatgagactattggcgatttgcggcagtggttagatgagtactataactag

SEQ ID NO: 388 - DNA, 1284 bp, Pseudogymnoascus pannorum
atgccacgcttcagctcattctggcctgctttacgcgccatctccgaaatctcaaaagtcaataaaactgtcgatgaggaagcgctggaaacgttcagaacgctggagccgtcagagaaaagtattgggatatcgaagtcgcccggcattgggagtgctggagtttcctcgtcctctacagtaccagaagtaaaagctgctaagcaacgagagcaacaccgaggaactcccaaacgagcggaccccaaaagccagcagacagcgaaacagccaaattcccaagtcgaagtctatggccctcgagtaggctgggcaacagataatattttggacgtcgaagtcgttcttgcctccggagaaattgtcaatgccaacgctacttccaatcaagatctattgaaagcactgaagggtgggaacagcaactttggtatcgccacatcatttaatctgcgcacattctctcaaggccaaatgtgggcaggccttcttggccaatccatcagtagccgcgaggaagttttccaagcggtctccgatatcgcgtcgaatgccaacgaggacccttttgctgctttggtggctgacttcaagttcaattccgccactaaatcttgggtcatgaaccataccgtggtatacacgaagccggttgctaatccgccaatatttgaggcgttggttggcattaagccacaattaagcaaccaaattgcaataacaaacatcagttccattgctctggggcagaagatgggggcaaaagtcgcatacaataagaaccacctgtcttacacgggtacatatggcaacgatgcagcacttctctccaagatctttgatatcagcaatgccaccgttcacaagattatgccgcagatcaacggagggattaagtgggttataatgatggagccatttccagcgctggttgacagctttggagaaaagaatggcgggaactcgcttggtctaagtgccgagactggagatcgcattgtcatcctgcaattggcgcatttcgaggaccacgatgcgaatgacttggtcgacacggagctcaaaaatatgttctatgagatcgcgagcgcagcatctgagatgggactcctgcgccgtttccagtatctgaattatgcagacaagcaacagaatcccatagcttcatatggacctgagaacgtggcggcactgcaagccacgagcaagaaattcgacccgaagggtttgttccagagacaggcgcccggcgggtttaagctcggaattcagcaagtgatttaa

SEQ ID NO: 389 - DNA, 2031 bp, Trichoderma Virens
atgttgactatgtccttgaagaggcacttcccatttcaaatttctagattgcaagtcaaccaatccaacccccgcttgcccatctctagccatttgcagaataatcattccgagccaaagttgtccatctcttccttccaacctatggccggttttcaatatccaggtattaacttgcccgttgacacctctcaacgttatgatctggataatctgccaccagtttacggtattggtatgccacaagctaggggtgctacttctgaaattctgccagtcagggaagtcgccatgatgttgattatggaacagttgactgataagttgaactggcacgaaaaggtcttcgacgaagcaattgtccaaaaatggaggcaggaagccaagacccaatctgagaatggtttgtactcaagagtcatggaagagaaaatgcactggaatcgcattccaatgccacagacaaggttgatctctgacgaagcctttgaattctgcattgccgaattgaggaataaggctgcttattttgccaaaaccgggttgatccccactttggattctgctggcaacaccattgttaagtctgacgacttgatgaatgctcaactgagggatgaattggtccaagctttcgaaactttgagagccgatcaagcagctaatgtcgattggcacccaggcactaacgacatggttcagaacctagtccatccctctatgtatccattcgttttttctaggtcctcttttatcttggaagagcaaatcggcctggataacgccttcgacttcgttggtaagggtgaaattcccccagccattgatagatttccagattacggtaggaggttcttgaacatttgttggcaaccacatttcatgggtattgttccacccgaataccgctcctccttgtatcagtggttacctgctaatgttgcctttcgcgatgacggttctgccaaaattacttcctatattaacaacctgcatcccggtaaatacccagcgatttacaccgctatcgaacatgctattgatgccgctattccagcttgggatcaatgtttgagagaggatttgagatggagagatactgttgccgctggtagaactgaatccagatttgatgctattactgaggctgatgacgaccaagaaggtttgtggactgtctctatgaagtatgaatggccagatgacgagtcttggcacttcactaataggtatcaatatggtgatccacccaaaccatccatgggcgaaagaatctatcccggcaaatgggttgaaggtagggaagctattattccagaacccagacagtttaaggaaatcgattacactcctccacaaaggattcgcgacaagttcaaggaacacggcttgcagatcatcgtcaaaatggcttccattgaattgactccagaaaaaccctactttccagctggctcatggcacattgaaggccaaatgaacgagagaatttgtggtactgctctgttttacttggattccgagaatgtcaccgactctcatttgtccttcaggatgcaaaccagggatgatctcaacgaatccattgagactggtcaggacaattataactggttggaaaggatttatggcaccactctaggcaacggtggttcctgtattcagaactacggtgatgttagaacctgccaaggtagagtcctggctttcccaaatgttttccaacaccgcgtttcttctttcaggttgaaagatgaaactaagcccggtcacagaagatttttagccttgtggctggtcgatccacatgaacgcattgtttccactgctatggttccaccacaacaaaaagattggtggaccgaagctgctaaagcccaagaggattctcaaatggaaattccagagtccttgatgactgttgaagaagctttggagcatcgcttgaagctgatgcacgagagatctagacaagaggctgaaaccaaacaacatactgagaaccgctcttacaatttttgtgaacactaa

SEQ ID NO: 390 - DNA, 1698 bp, Trichoderma Virens
atggctagattgattgccttgttggctacagttccagcattggtttctgctgctgctattaacactacttgtagatgtttgccaactgacccatgttggccatcaactgccgattggaaagcttttaatgctaccgtcggcggtaaactaattgctactgttccattggcttccgtctgtcattcctcctctttcggttgttattccgcttctaaatgtgatcagctaaaatccgtctgggacttcccatctacccatatcgaatcttcttctgaccctgttgccccattcttttccaatagaggttgtgatttgtttactgctccagatgctcagtgcgtcgttggttccttggtccaatattctgtcaaagctgccaacaaagctgattacctggctaccattaagtttgctcaacaaaagaacatccgcctggtcatcaggaacactggtcatgactactatggtaagtctactggtactggtgctttggccttgtggacccataacattaagactacccagttgttgaattacaatgccaacggctacaagggtaaagccattaaggttggtgccggcattcaaaactctgaagctcaagcttttgctcatgctaatggtttggctttggttactggtaatggtggttccgtcggttttgctggtggttattctcaaggtggtggtcatggtccatttgctactaaagctaacggtttggcagcagatcaagtcttggagtgggaagttgtcacttctacaggtcaatacttgattgcaactccatctcagaactctgatttgtattgggctttgtccggtggtggaggtggtacttatgctgctgttttgtctatgactgttcgcgcttatcccgatttgccatcttctgcagccaatttgactttcactaatcagggtgtcactgatgatgctttctacgctgccgtctccaaatttctgacaactatgccctccattgttgattctggtgctactgccgtttttttattggctccaggcattttcttgttgcagccagttaatgctccaggtgttactaaggctcaattgcagaccttgttgaacccaactctggactatttgactgcaaacggtatcggctacgatttccatgttgatcagttcccaactttcttggactcctttaacgcctataatcccccaccaaatgttaccgaatacaacatcggtggtagactgatcccaagaactttgttcaccactgcttcaggtgccgcttccgttgtcaatgtctacagatctattaataatgccggtggcgtcgtttctggtgtctctttgaatgttgctaacggaactaaggtgtctaatgctgtcaacccagcttggagaaccgccattacttctactgttatcggtattccatacgatccactggtcttccaaaacaacctgaacgctcagtctttgattactggttctctggtcccacaattggatgctttgtctccaatcaaaggtgcctatctgaatgaggccgatatgaaccagccgaactttcaacaggtcttttatggttccaactacgccaagctgaaatccattaagaacaagtacgatcccactggtaccttctatggcttgactgctgtcggttctgatgattggaccgttaacaacactacaggtaagttgtgtagaattgcttag

SEQ ID NO: 391 - DNA, 915 bp, Trichoderma Virens
atgcacccagaacataaagtcgaacccgcttcttccgccgtctccactttgttctacattccatacctgatctgggaatttaccgagtccaatttcccaacctttgtcattccaaacaccactttcggtgtcttgggcgctttggctggttctcacttggctgatggtcaattaccatctttgtggcaattgtcccaagctttgcccttggtcgttgccttcaattggtacaatgtcctgatcttcgatctggccaatcaaagatccgaagaatccgtcaaagaggacctgattaacaagccctggaggccaattccatccggtaaaattaccggcgaacaaactagaagatccatgttggttgccgtccccatcgccttggctttgaattattggttgggtgtctggaaagaaggtgtcttcatccaaatcttgacttggttatacaacgacctgaagggcggcgacgaagttgtcagggatttgatcatttccatcgcttacggttgtttcaaccacggttccttgagaattgccttgggttcccaagccactgtcaatcaagaaggtatgacctggatcctgatcattagctctgtcatcttgaccactatgcaagttcaggatttgaaggaccaagagggcgataggactagaggtaggctgtctattccattgctgttgggcgaaaagttttccaggttctctatcgctatttctgccgctgtttggtcctgtgtctgtccatttttttggaagttgccaccattggcctatgctggtccaatggttattggtgctgtcttgatgacctccgttttgttcaggaagaccgttaaagccgacgatcaatcttggaagatctggtgcttgtggactatgtccttgtactctttgccactgtttactttgtga

SEQ ID NO: 392 - DNA, 1782 bp, Trichoderma Virens
atggcctcttatgactatattatcgttggtggtggcttggctggcttagttttggctgctagattgactgaagacagttccaaaagggttttggttttggaagccggtgaagatttgactgctgatgctagaacttctgtccccgctatgtggccaactttgttgaatactgacgctgattggaaattcagaacagccgcccaggctggtttcaacaatagggagatttcattcccacaaggtaaattgttgggcggcagctctgccttgaatggtttgtcctttactccatcctccaaagctaacgttgacgcttgggctaagttgggtaatccaggttgggattgggcttctttctctaagtctttagccaagtcttatactctgacttccaaggctggtactactggttctggtccattgcaattgtcctacccaaacgacaccaacaactcttggccaaaaatttggcaacaaaccctgggttccttaggttttaggcaatccggtgaatcctacacacaacaatcttccggtcccgttactgttgccgattctattcatccagctactaaaacccgctcttacgctggtaatgcctatttggaaccagctaggtctagggaaaacttgactgtcgttactggagctgctgtttctaaaattgtcttcgcgaaagatggctctgctgttactgctgaaggtgttcagtacgtcaaggatggcgaaactcaaaccgccaccggtaaagaaatcatcttgactgcaggcactattaattctccaaggattctagaacactccggcgtcggtgattctaagttgctagccaaactgggtgtcgatgttgttattgacaaccccaatgttggtgagaatctgcaaaaccacccaatggcaggtttgtctttcgaggccttagaagatgccgaaaccattgatggtttatctagacaagatccagcagctttgcaagctgctatggctgcttacgctcaacaattgggtccatttgcttcttctggcactaataacgctgctcaactgccattcccaggtattcagactgccgagggtaaagctgaagttgaggctttgattgaaaagtacattactggtgctaagaacgtcacttccccatttgacaaggcccaagccgagttcgtcaggtctattttgacttctccagaggaagcttctggttactacatctccttttctggcttcgcttcttttaacccagatggttctatggctccaccacctccaggtactgaaaaatacttctctgtcgctttgttgttgactcatccattgtccaggggctccgtccacattaactctgcctctgaaacctctactgatgttactatcgacccacagtacttctcccatccactggacattgaaatctttgctagacacttgcgcttcgttgaatctttggcctctgctgaaccattggcttctcatttgaaggttggcggtaagagaaacccagctgctcctccagctggtattttttctgctgcatctggtttggaaaaggcgaaagaatatttgagacagactgctgttggtgctcaccacttcactggtacttgctccatgatgccaaaagatttgggtggcgttgttgatgctgaattgagggtttatggctgtccaaatttgagggtcgctgatgcctctattatcccattgactccaagagccaatccacaagctactgtttacggtgttgctgaacatgctgctaccattattaaaggtggtttgtaa

SEQ ID NO: 393 - DNA, 1668 bp, Trichoderma Virens
atggatttttactacgccaatcaacaagctatcttgactgccgttggtgctttgtctggtatcatcgctcatattactgtctatatccgcggtgaatggcacgtccaagccccacaaattaccttgcaattgttcgctttgtacgttggcgttccagttttagtcagaattttgaaggacactgtcgttgcccaaatcctgcagggtgtcgtgttttggtcctacggctatattctgggtttgatcgcctctattttgttgtataggattgttttgcatcccctgactagggcctcgtttcagggtccatggtatgccagattcactaagatttggcatgtttgggctgcaagaggttccatgaaccatagggtcttggacgatttgcacaaaaagtatggcaacttcgtcaggactggtccagctgaaattacagtcttccatccagatgttttcatggccgtcgatggtcccagatctgaatgtatcaaagccgaatggtacgacattttacatcccggtcaagccttggtcactgctagaaataagtccgttcatgctgctaggagaagggaatggaattctggcttcactactaaagctttgtccgaacacgaggctaagatcctgaagtacgttgacaagttggatcagtgtattgccgaagacgcgaagttggaaaatgtcaccaatatgcgtgatttgctgttgtggttcggcttcgatatcatgggcgacttcgtcttctccaagtcttttggtatgttggagaacaagcagtggcatcatattattgtcagactgcaaagggctctgtctctactaggtccattctcctccgtcccatggttgatccaaattggttttaaactggctccaagggtgtctgtcttgaaagattggttcgacactgttgcctggtgtcaatcccaaatgagggatagactggaaaacggttctgcttcccaaagccaagacttgtcctactacttgatggaaaaggattctgaaggcaacggtgctactgagaacgaaaaatggcactgggctgctggtgattcattgttggctattgtcgctggttctgaaccaacagcagttgctttgattgctgttttttgtgaactaggtaggcacccacagcacgctgagcaaattcatgaagaggtcaagaacgtggacgttactgatttgaagactctggtgtctttgccccatttgaatgccgtcatcaaagaatccctgaggttgcacccagctttgttgaccggtggtaataggaaaactaccgcttttgggttgaccattgatgatcaatttatcccacccaataccactattgtggcccccaggtacactattggtaggttggagtcttgtttcgagaggccatctgattttatccctgaaagatggactactaggcctgaaatggtcagaaatggtgctgcttacgctccattcggtactggccatcactcttgtctgggtaaaactttggctctggatactatgaaatacgttctggctaggatcttgaaaaactacaggttcagggctgctccaggtgaagattccttgtctgccctggaaaccgtcagggatcagtttacttctaacccaggcattctgaaattgcagtttgaaaagagacatactatcgactga

SEQ ID NO: 394 - DNA, 864 bp, Trichoderma Virens
atgatgcaaccaccattgccatcagctactccatcttggagaaacgacacttatgctgctatctctccagccagaccagaattgtctgcttctggtaagactattgtcatcaccggtgctggttctggtattggtagagaaactgctaccgcttttgcagctgctggtgctgctagaattgctttgttgggtagaacagaagcttcattgaaggaaaccgctgctgctttgccatctactgtttccacttcctcccatgttgtcgacgtcacttctgaagaatctctggctaaagttgctggtgaaatcggtacttgggatgtcctggttttgggtgcaggtcatgtttctgttccatccactattgccgcttccaactttaccgaattctggcaatcctttgaaaccaacaccaagggcacctacgcctctttgcatgctttcttgccaactgctaatgctactcatgctgctgttattgctgtcactactggtactaccgcattgcctgctactatggtcccaggtctgtctgcctacatgtcttctaagttggctcaaactaagctgattgagttcttggccgctgaacattccaatttgtttgccgctactgtccatcccggcatggttgagactggcatttttaccaagtctggtgctaaggccgaggctttgcccatggataaagtccaattgccagctcattttattgtctggttggcttcctctgaagctgcttttctgaacggcaggtcagtctgggctaattgggacgttgacgaattgaaggctaaagccgaagccattcaacaatctcaactgtttactgctggtatcaatggctggccatttgctccatag

SEQ ID NO: 395 - DNA, 1068 bp, Trichoderma Virens
atgtctgctggtccaagaggtattcaattgctgatttggatttgtgtcttcaccgttttgtgtaccgtctgcattggcctgaggttctgggctgctgtcttgtctagaagaagagctttgccagacgattacatggtgttgttcgctttggctaatactatctccttggagggcgttgtcatctgggccattttcaacggcttgggtaagcatactaacgaattgaccccatacgagtttggcgttcagttcaaattgattctgtcctctgccgtcacctggttgttgggtactgtcttcatcaagttgtccgtcctgtggttgtataccagagtttttagcaccaagaagttcaagctgtggtcccatatcatgatgggtgtcgtcggctgctatggcgttgcttttttcgtcttgttcatgactcaatgtagaccaatttcccaacaatgggatcccgtcccaggcggttcctgtagaaacatcgtgatccaggaattaacctctgtttccttgaacatggttgtcgatattgctatcgtcatcatgcccttgcccgtcttgtggaacctgcaattggctgtcaggtctaagttggttgtttccgttatgttctccattggtttcatcactattgccattatggcctggcgcttgcagttcaccatttccaccctgaacgacaccgacttcgttttcaacttgttcgatatcggcttgatcagcttgttggaattgtggttgggtattatcgctgcttgcatcccaactttgggcccactgctgaagacttacgttaagccagtcattaccaggttgaccgagttgtctgatggtaacaatattaggttgcaatctgccactgccggttctaaggctgattctcgctccactttgtacggcaagaagcaatactcccaaatcgaagaggaatcttctaagtctttccacactaacggtgctgagatcccaaccgtcaccaccaagatcaagtacgatccaggtaacaaggttgtcaccgatactagaggtgtcatctatgtccaacatgatattgaagctcaatag

SEQ ID NO: 396 - DNA, 879 bp, Stereum hirsutum
atgctcccttcgacgtacgcctgtgcaaagtatcacttgtacaccgcggtcctattcacttggacagattacaagacgattttacttccagttgccacatttgcttccgccaccgcccccgttcaatcgctctcaagctttattcaggccttgctttggatatggatccacttgcttttatgtaatgtgtccaaccagacaagcggggtagaagaagataggatcaaccgacactggcgtccacttccggcgggcagaatcacatctcaccaagcctcccgcctacgctggactacggtgttactctgttttatctggtcgagcttgtatggcctccgactagtgtccatcagcacgatccttttcatcacgacttatctttacgacgagattgggctttcgaaccatccaatcgggaagaatttctgcaacatcggaggatacatgtcattcgagcttggtgcaacgattctcataggcacgtctataggacacgaaaaacaactggatattatatcgctcagcgctaccatgctcagcgcagctgttatcttcacgaccatccaggcacaggacttctcagacgtcgtcggtgataaagctgcaggacgagttacgcttccgatatacgcaccagaattttcccgcttccttaccttcgtcgccctcacaacatggtccatgattctgtcggtattttggggaatagggctgctgtgcgcgacagtgctggtttcgttgggggcgtacgtaggctaccgttattatttctggcgtactcaggagatggacgagaaatcatatctcatcttcaacatatggctgattgtcgttcatcttctccctatccacgctcggacgaacgtactgaagttttga

SEQ ID NO: 397 - DNA, 1524 bp, Stereum hirsutum
atgatccctacggaatttcccaatggctcattattagtctttgcgatccttgctctggcttttcttctccgaagttattacccccaccgtcgtttacccgtcccacctctatgcagagtgaatcaaaaacacagcgaacagcgctcgtgggttacttattccatacagtctaagacacttggtagtgcttcatcgcattcgacctgctctcctgggctaattgttgttattaacacccgcaatgccgccacagatctcttggagaaacgcaagtccttcgcctgccggccccgtttccccatggcggagcttatggggcgacagaacaacgtcgggtttacctactacggcgagaggctacagcgactccggaagacacttcatgcttctttgaatacgaaggcggtgacggatacttggtccaacatgcttgaggcccaatcattggctctttgtcgacacctctttcggtctccgacttcatttgtcgactcaatagagataaatatacaggaactgattggaaggttctcatacggccacaaaccagatgccgagtacatacgtgtggctaacgatgtaatgcaccacaccggccaagctcttcgtccaggaagatggatggtagattctgtaccagccttgaaatggattccttcctggatgccgggagcaggcttcaagcgttgggctatggaggctaactccgtattcatccgcatgacacgggagcctttctacaacgttaagaaggacatggagtatggacgtgcgaagccgtcttttgtggccaattcgctcatgagcttaccagaggaccatgatgccgacgacgaagatatcatcatgtatgcagccggaagtctctttagcgctgggacggaaacgctatccggagcaattctaacgtttttggtgctcatggcatgccatgaagacgtccaagagcgtgcgtatcaggagattatcaccgtcgtcggacgcgatctcctgccaggtcttgaacatagacagtctcttcgatatgtcgacgtattgattcaagaagttcaccgatttaatccggcagtccctcttgccacgcacagcaactaccaggaagaggattatttgggtcatcgaatcccaaagaaaacctggatcctggcaaacatctgggcgatgctgcacgatgaatcagattatcctaatcctggttcattcaatcctgaaagattcctagctgtagacgacaaaaatgcgcagcttgatccacgctccctgctgtatggatttggacggagacgatgtcctggtgcacacttcgcagatgcgattgtctacctaattgtttctcgtatcctaaccttattcgttattcgtccgaagatcaaagagggccgcccgaaccctcctgtgttggagttcatacaggcattcgttccggctccaaaaccatttgagtgcgatattgtccctcgagataacgcggcggaaatgctaggcgtggacagcgctgcgcttaatggttccacggatttctga

SEQ ID NO: 398 - DNA, 1479 bp, Stereum hirsutum
atgttggtgattattggatctgctatcgtcctagccaccttcgcgctctctctttgttttcgcccgtattcagccatccgacgcctgcctagtccggctgtaagcgagctggtatggggtcatgagaagttggtcttctcaaacccgccagggcacctcttcaggcaatggactcgggagcttggcctaaccttcagaatccgagcagcacttggtctagtacttagtgacccgctcggcatctcgtacctgctacagaagaggattttcgacttccatcacagcagagttgtccggcctcggattggacgcttactaggaaaaggtctgggctgggtcgagggtgaggccgagcatagacggatgaagcagctagtcatgccttcgctcaccgtcgaaaacatcaaaggcatgtcctacgatatcgtggatgcaacaataccggtcatgaatgacctcactcacttactggaggcgagtggtgggagcgctcgggtaaatgtccttgatttgatgaacaaggttactcttaatgttattggcagagtggctttcctccatgattttgaaggcggtaacagcccagccgcgaaggacattcttagcgcacgttcaaagagtctgtcgggaatcgcccgctattccgcgttcttgactttgatgttactacgacgattcccagttctgaacgatctgcccatccccgctctccaagcgcagggtattatgtcaacaaccataaaatcgggcattgcgcgggagatcgttcggagacatgaggaggcagcacctcctattgagaagaagagcaaagatctactcagtatattgctcacagctgttagagaaggtcgaatgtcagaagcggagctttacgaacagtggatttctagggttggaggacaagaaaccaccagctttactctggctttcagtgtcctcgagatttctcggaatccgcatatccaagagcggctgcgtaacgagctcgcaagcatcccaggggaagtgacatatgaagacttcgagtctaaactcccatatttggatgccgtgatgagagaaacgttaaggatgtatccagccttagcttacatggagcgtgtagcaaccaagtcggatgcgatcccggtccagctgccaatccgattatcggatgggcgtgtagttaacgaggtcgaggtccaccccggacaaactgtgattattcctatcatcgctatccatcgatccgtgtctgtctggggagacccggacgtctttcgtcctgagcgctggttggagcagcttccggcccagaaggacttagtgtcagggtggtcgaaccttttgagcttcagcaatgggcccagaacctgtattggcaggaaatttgccatctatgaatataagcaatcagtggagactgtacgacagccttggaggagatggaaccgggagctggaggcgaccgtggcactcaggagtctgatcaagtag

SEQ ID NO: 399 - DNA, 1023 bp, Stereum hirsutum
atggcccaagcagaatatcgccagctcggcaagtccggccttcgtgtctcagtccccattcttgggggaatgaccattggagaccagcaatggctgccttggctgcttccggaagataaggctctgaaccttctcaaaacggcctgggatcagggtatcaataccttcgacaccgccaacatgtactccaatggcgaatccgagcgtatcatcgccaagttcatcaaacagaatgagattccaaggcgcaacctcgtcatcatgactaaaatcagatttcctgtctcggaggacgatcaagtcgttaccagttttgccggccccaagtactatcacagccgcgattacgtcaaccaaggtggcctctctcgcgtcgccatcttcaaccaggtcgacgcctcgttggcgaggctccagacagaatatattgatcttcttcagattcacgcgttcgatcccgaaacgccagtagaagaaaccatgaaggccctccacgatattgtgatgtccggaaaagctcgctacatcggcgcctccaacctccgcgcgtggcagtttattgagatgaacaacgtcgcccagcagaactgctggacgcagttcgtgtccgttcaagtggagcactcacttctttaccgtccctacgagctcgagatgttcgcatactgcgactacaaggggatcggcatcctgtcttactcccctctcatggacggtcatcttgcccgccctgtaggggttactacggaccgaagcaaaatatacgaaggccatctgttggaaaagaagaggagggagtcggacaaccaaataatcaagcgcgtcgaagagctcgcgagcaagcactcgtggaagatgtcccaagttgcacttgcttggtctcttacaaaggtctcgagccccatcgtcggagctaatacatccgagagggtcaaggaagcagttttggcagggaggagactcagtcttgaggacgttgagtatctcgaggaaccgtacgagttttgcgctccgaggttctaa

SEQ ID NO: 400 - DNA, 1515 bp, Stereum hirsutum
atgtcctctttctggagaccagatgccgaactgtcccattcagaacgacccctacacactaaaagtaaatcagcgcctttatcccctgaggctatcgacgacctcaagaaaaatgaaaacagcgaatgggaacaccatccgaggaaccctctcaattggacgtcgtggaagaggtggagcgttattgtcgttatatctttatacatgtttgtaaccgtactggaaagctctgtgatggcccccgcattgccggacatcagtcggcatttcagcattaacgaccagactgtcgttgttttgacactatcgatatacctactgtcatttgcaattgcaccactcctatatgcccctctttcggagatgtacggccgtttcttggtagttcagatcaacatggttctcttcctgggttttaatatcggatgcgtgttcgctccgaccacaggagctctcattgctctacgttttctcagcggatgggttggctcggtgcctctagctttaggcggtgcgattataggcgatctattccctccggctggcagagggcttgctatggccgttttcacgatgggtggaatgatcgctcctgtggcaggaccaatagctggcggttttctgacagagacctcaggtttcaagtacatcttcgtactcctggtctgtctctccggcgtgtttcttctcattagcatacctttgttccgggaaacctacggcccagtcatactagcacgctctttccgcacccccaaagacttggaaaatacctccatggctctcaataggagggagagcatccaaaacgtgtggatcaatgtcaagaggccctttgtactacttgcacggagcttcatatgtttcatcctcagcctctacatggcgacttatgcaggcatttggtacttgatgttcacgacgttcccaggcaactcatataagtgtgttgtctcagtgctgtttaccgacatctaccacttcaacaccggaacagtgggcttggcctacatagggctcagtatcggattcgtactggccactttcgtagtcgctggggtaggcgacagagtcttcacagagcttgttcgtcgcaacggtggcaagtcggccccagagatgcgcattcctttgctcatcgtaggatcgttctttgtccccatcggcttattctggtatggctggtctattgaagccaaaattcattggataatgcctatcctcgggacgggaatatttgggtttgggatcgcacttgggattcaattctctcaactttacctcattgatgcctttgggatttacgctgcatcagccctctcagctgctgcggttcttcgctccatgttagcctttgcattcccattgtttggttctcagttgtacgagactttgggcaatggaggaggcaactcgctactcgctggaatctccatagttcttgggatcccttttccaattttgatttggtacaaaggggatgcaattaggaagagaaacccccttgacttgtaa

SEQ ID NO: 401 - DNA, 891 bp, Stereum hirsutum
atgcttcttcttctactattctcttttgggtgctccatcttggaacctaccttgtatcatgtatacactttatatctattcaccttgactgactacaagaccatttttattccgattacggttttcgcctgctctacagctcccatacattcgatctccaatcttttccatggaagcacatggatatggatgcacctactgatgtgtaatgtctcgaatcaactgagaggggagcaggaagacgccgtgaatcgaccatggagaccactgccgtcgacccggatgaccaagaggcaagccacgacgctccggtgggctatggtggtgttatgcctgctctactcttccgcctatggtcaccgattagcatacgttactgtcggccttttcatcacaacatacgtatacgacgatctagggttctctcagagtccgctcggaaaaagcttttgtaacgttggtggttatgcgactttcgagatcggcgccacaaagatcatgggtgcagaacacgagctagacactacctcacttgcgtccgtctttcttagcggcatggtgatatttactactatccaagtacaggactatcccgacatcgaaggcgacacagcgtctggtcgggtcacctttccaatttatgcacccgagttctcgcgattattcactctgtcatcgatcattatctggtccttcgccttgtcatggttctgggatatcggcatcctgagtcagtgctttctcgcaggattgggagtatacgtcggtgctcgttactatctccatcggacaccaatcgcggataaaaaatcatacaagctcttcaacgtttggctggtgctgatacatcttcttccactccacgcccgcatccgtgtgtttctctattag

SEQ ID NO: 402 - DNA, 1578 bp, Stereum hirsutum
atgaagcgcttgccttgcattgccctttcaccctacgcccatcttcctacgctgcgcatcatgaactatatgctatcctttctcgttctacttgtatcacttttgatgctcagaatcatactgaagaggaacacagacaactctggtgcccatcattatcctcctggtccgcccgcaatacccgtccttggtaatatcatgactattccgaacacgggaccatggaaattattctcaaagcttcatcgtgactacggagaacctatcttcttttggggcttagggaacagcatccttgttctcagcacaatgacttccataacagatctcctcgacaagcgaggggagaactattctcatcggccggtattgactgttttaggagaactgatgggattggatcgtagcatgccgatgttaccgtacgggcgtgagtggcgagagcagagaaagctcgcccacgttgccttgaacccatctgccgtgagaaagtatcacatcgtgcaggagaacctagcttctgtattggcgcttggtattctcacaaaccccgaaggattctttgataatgtacgactttacgcggagcgcataatattctctgtggtatacggtgtgtacatcgatggttccaataatgagtatgtcactcaggcagaagaaaccatgaaaattgtgggagacgcaatggtaccaggagcgttcatctgtgacttgttgccttggatgaagcatcttccttcgtggttgccatttcgaaagcaagcacattatgggagaagtatgattgaagcccttgtgaccaaacccttcgaacacgttcaacgagagatgatgacgaatatcgctgcaccatctctcactcgagaactattgactttgcaacgtaacgatttcgcgtcttttgagagctccgttaagtgggcgactggatctttatatggtggtaggcataacatttgggtcttttcaaagaatttttgtctcgcactgacgggaactggactgtcagcgggcggcgaaacgacttacgccaccatccttactttcatgatggcaatggcaatgaatcccgaaactcaacgtaaagcccaaaaggaggtcgatgaggttatagggatacatagacttcccgtcgtctcggacaagacacagctgaaatacgtagcagctgtcatcaacgagacaatgagatggcatcctgtgttaccgctgggcatcgctcgccgtacggaccatgacgatgtgtacatgggatacttcataccaaagaatactgttgtttttcctaatgcatgggcgctcacaaggaggcacagcgacacgtacgatccagaacaattcatcccggaacgttttatcgacccttccgaagcaacggacgatccttccacttatttgtttggatttggaagaagagtctgtccgggtaaatctctggcggagaactcggtattcattgcaatcgcgactatcctatctgccctagatatctcagaagacccggacagtagaataaccccagcatttacggaagctttagtaaggtatgattctccccgggagctctacaaatga

SEQ ID NO: 403 - DNA, 1578 bp, Stereum hirsutum
atggcgactgtcatgtattctcttctcgttacgaactgcaccgtagttcacgttgctgtgctcatttcaatcgtgcttgtataccgcaggctttttgtaggacggagatcttctcttgatccgttgccctatccagatgaagaaccggagtggatatggggtcacgaaaaacgcgtttatgacagccctccagggcaggcgtacttacggtggatgaagagtgttgggcatacctaccgcattcgtgctgcccttggtgcccctgacgttcttgttctgggcgatccgctcgccatttcttatattctccaagagaaaatttacgactaccaccatagcgctgtggtacgccctagggtggctcgcttcctgggaaaaggcttaggttgggtcgagggagaatcagagcataaacgaatgagacgtcttgtcagccctgcattctcggcgcaaaccgttaaagacatggaaggcgaaatatttcaagcgacgtctacggctagtctcaatatcgaggactcggacggtgaaattggcgtaaacatattgtcatggacaaatcgaatgaccctgaattccattggacgcgtcgcattcttgtacgatttcgaagccgggaagagccgcgaggcacagcttatattggacacaaggcggaagtcgctaaccggtattgctcgatacgcctcgttcttaactctgatgatgctcaggcggttccctgctctcaatagccttcctgtacccgcccttcaggcgcaaagcctagtcacgacaaccataaagtctgtcgtggccaaggagatcatagcgagaggttcttcaacatctgatctccgaactcgaggcaaggacctgctaagcagactcttggtagcccatgatgagcagcacctttcagtcgaggaactacatgagcacatatcgacatttttagtttctggacaggaaactacgagccaaacggtcgcgttctccatcttcgagctttcccgtcacccagagatccaacagcgtctcagagaagagttggacacatcttacccatcttctacaggcacgccgcagtcacagctaccttatctggatgccgtgcttaaggaaacactaaggatgtatcctgcccttccgtacatggaacgtgtcgcaactaaatctgatagaattccgcttcaaacgcccatcagtcacggtggagatcaggcgctacgggacattcgtgttgaaaagggtcagaccgtcatcatcccaatcatatctcttcaccgctctgatgctatctggggcgatggaagtgtctttcgtcccgaacgatggcttgaagctttacctcatgaggcacagcgtcttccagggtggtccaacttacttgcattcagtgatggacccagagcatgccctggaatgcgaatggcgatatttgggtcaaagcttatattaagctctcttgtcaagaaatatcgcatagaaagtaataactcagaagtagttctcaggatttcgtcaagtttgcagccttgggtgattgatgattcggaccaaggtccgcaagtgcctgtaacgctgcacatgcggtaa

SEQ ID NO: 404 - DNA, 1512 bp, Stereum hirsutum
atgcatcttccattcgcctggataatatcgcttattacggtcgttggagttacgtgctggatatgcaaacggtgctttgatatccggaatctctcgcttccgcctgggccgccagacaacgtgcatgaaaatgaacgcaagtggatggcttactcacggtggtccaaagaatcgggcattcaaggtcctctcgtcacactgtccacggcaccacacccaatgatggttgtcagcggacgcacagtaatccgagatcttctgataggaaagaaatcgttttgttgcaggccacgcatacctatggccgagctcatgggtagacaaaacaatgttggcttcacgtactacggaaagcgactcatcgcgatgcgaaccctgcttcactccgcccttagcctgactgaagttacttccacgtggatggaactcatcaactaccaggcggatgatctttgtagagatttcattgtgtctccggaacggttctacggtcatgttgaagccaatatacagaaactcatcggacgctttacttacggccacgagccaagtcccgagtatctacaaatggcggcccaggtgtcgcgacacactgggaaagctgtggaggcaggccgatgggccgtgaacagtattccagctcttatgtgggtaccggcatggatgcccggtgctggtttcaaaagatacgccattgatgcaagaaagctgttcacgcgcctgctcaatgaatctgttgcgctcgtaaaacagagaatagaccaaaatgaagcggacacgtcctttgttaaacaatctctgaccaacatctcgctatatccatcatgtatcgatgagtcacttgttatatcttccgcggggagcttgtttagtgcagggacagagacgttgtcaggtacaattctttcctttatcgtcctcatggcaaaccatgaagatttccaagaccgtgcatatgcagaaattctgtctgttgtcggcacagataggtttccaaattgtcgagaccgcccatcgctcatatttgtggatgcacttatccgagaagtataccgattcaatcctatcgtacccgtgatacaccgtagcaactacgaagaggaggaatatgaagaacattttattcccaagaagacttggatcctcgtcaacctgtggtcgattttacatgatcctaacgtctatccatcgccagaaacattctgtcccgaacgttttctcaactccgataaagacatcaatcccgatccccgctcttttgtttatggttttggacgaagaaggtgtcccgcagtggatttcgcggatacaacactttttattaccataactcgccttctgatggtcttcaaaatttccccggagatcgttgatgggattgcatacccgcccctgctggagattatggaaggatttactccggctccaaaaccgttccgatgtaaattcatatctcggcaggacagcaagcgcttgctattcgatccatttgacagtaccacagataattga

SEQ ID NO: 405 - DNA, 996 bp, Stereum hirsutum
atgagtacctctttaactaactacgctcttccggacagtaggatcgaggttgtgcggcttaaccagcaatatatcaggttcaagaaacttttcggacgtaccggaccatttccgacaactgtcgacgttgacggcatcgaccatgttctcgaggttgcggccggaacatgtgcttggactctggatatcgcacatcttcaagaagtctacacccgcctcccatcgatgccatcatcgactcgtcctgagtctacgtcaaagccaattcagttgtacgcctgcgatattagcacagataagtttcccccgagggacgtgacggatgcgctcggtatcaagacgtttcaacaggacgttacacaaccctttcccgacgagctttacggaaagtttgacctcgttcaagcgtttatgcttgtcggttctttaacagaggctgggtggaggagggctctggagaactaccgcagacttctcaaacccggagggtttctcttcatgctcgaaacggatgtggccctgtattcaacgagcctcccaccaccaccaccaccgcttttcccccttgacatcgacggtgttatggacggtctcacgtggattcacagtgcgaatcggttgttcaccgggttcaacataaaccgagacctggttcctaatatatcgtcccggttgccggcgctgttaacggagcagtctctcaacatcatacaagaagctaaggctatctcaccggttggaaagctctgcaaattataccgcgcgttggacggcgcagatttatctgatgattgggatgactctgttcagggcactcgggatgtttttcgtggattggctcagtcaatgcttagaagaagcatgttggaggtaccaaaaggaacacccatcacgactcaggaaggtctgaatgagcttctcgcttggatatttcaggggttggaatcggatggggcttgtcatgtgatgacacagtggataataagaaggaactga

SEQ ID NO: 406 - DNA, 1284 bp, Stereum hirsutum
atgaactctgaggataccgccgctgaccatggaccacccagtatctcgaaagctgaagaaggattggaatctactgggccttctggagaaacgcccgcttctgcgctcatctctgactttcctgaaggcggtcgcgacggatggttgaccgtgttgggaggtgctcttgttctcttttcttcattcggtgccgccctctccttcggagtctttcaagactattacactcgcatttctctaaatgaacactccgcgtcgcaaatatcctggatcggatccactcagctgttccttgattttgctgtcggcctgcccgcagggaaactcttcgacgaaggtcatttcaggcttcttatgatttcaggaactgtcttatacagcttctcgttcttcatgctttcacttgccaaaccgcataactactaccaagtctttctgtcgcaggccattggtatgggactcggaatggggctagtcatcatccctgctgtctcgataccattgcattactttaggcggaggagattacttgctatgggattcatatttgcgggctcctctcttggcggtgtcattttccctatcatgctcaacaagcttatcaacggccgtgctgggttcgcgtggggaataagggctgccgctttcttgtcgctcgggctcttgatcatcgcaaatttgattatgaagcctaggctacccctcaaaaaggatcgatcgcctgatactgtggtaccgttgaagagcatattgaccgatgtcgcatacctaatcagtgtctttggagccttcctgattttttgggggcttttcttccctttcttctatctccagctgttttcggtacttcacggagtagacgaaaagcttgctttttactcgttgacggttctcaatgcgtccacaatctttggtcgcacaattccgaatttcgcatccgataaatttggacctttgaacgttgcgatcccgatgactaccatcgccggcgggctcgtatttgcgatgctgggcgccacaagtgtcggcggaatgttcacattcgcagtcgtctatggattcttcggtggagcatgtgcctcccgcatcggtatcgcaatgtttgtctgcggatttgcaatcctcaccggaacacccatcaccggggcactgctcaaaccgcctcagtacaacacctggacgaagcccgtcatctttagcgcggtggtcatcttggctggggtcggatgcctggtgatatcaaggcagatgacggtgaagaggaaggggacgtggaaagtgtga

SEQ ID NO: 407 - DNA, 819 bp, Dichomitus squalens
atgctctttacggtatccgatctgaagaccattctactccccgtatcagccttcgcatgcgcgacagcccctatccactccttcgaccggctcctccacgccctcatttggatttggatccaccaattaatgtgcaacgtctccaaccaggcccggacgcgcctggaggatgccatcaacaaaccatggcgtccgctcccttcgggacgcattagcgaacctcaagcccttgtgcttcgctgggtgacagtcggcgccgcattcagctgctctgccatacatggcggcgatctcatgctcaccactttctgtctctttctcaccacattcgcatacgacgagctcggtcttgccgggcatcatatcgccaaaagtgtttgcaacattggcggctacaccacgtttgaaattggggcgacgaagctaatgggagcaacgcacgatctagacaacgtatcagtcaccgcagtgtgcatcagcggcgctctgatcttcaccactatccaggctcaggattttgctgacgttgaaggcgatgctattttgggacgcaagacgttccctatctacgccccagagctatgccgtattgcgacagtcatcgcaatgagcgtatggtctctgttcctagtctcgttctggggcattggaactgtgtcaggggccacatttgtcgtcttcgggagcttcgtcggaagccggtattacttcctccggagacccgacgacgacaaattgtcctacctcctatacaacatttggttaaccatggtgcatatcatgccgaaccatgcgcgcacgcagttgttcgcatactag

SEQ ID NO: 408 - DNA, 1584 bp, Dichomitus squalens
atggcgggtctcctgaacgacacgttcaactccacgccagtgcttgtcatcctcgttctcgtgattgtgtggcggctctccgcagcctttcgccgcaagtctgtgctcgagtccctgcctgtgccatctggggcagagttcgtctggggccatgagaagcaggtgtttatgaacgaaccaggccaagcatacagaaaatggaagagcgagcttggcttgacctatcgcatcaaggctgcgttcggggcacccgacattctcgtgttgagcgatccggtttcaattgcctatatcctacagaagaagatatacgactatcatcacagcagggttgtgcgcccccgtgtagctcgccttctaggaaagggccttggctgggtggagggcgaggctgagcacaagcggatgcgccggctagtcagcccgtctctgtcacctgagaatgtgaagtccatgtcgagcgacgtgagagttgccgcactggaggtcgtcgaccaattcgtcagccatgtgcagtccggagcggagaagcctgtcaatatcctcgactggacgtcgaaggcaacactcaacgttataggacgcgttgcgtttctgcatgacttccaagcggggaatagtcctgaagccaagcagatcttaggcgggagacgtcgcagtgtttctcgtgccgctaaatacgctggatttttgaccttgatgctgctccgccgtttccccatcttgaacgatctgcctatcgctgccattcagtcccaaggcctggcaaaagtcgccatccagacgggcgtagcacgcgagctgattcggcgcaatcaagacatcgtcaaaaacggagatactaaggcctcgaaagatcttctgagcagacttctggttgcacatgctgcgggagacatctctgaggaagagttgtatgagcagatatccacattcatcgtatctggtcacgagacaaccacacagacattgggttttactatctacgaactctctcggcatcctgagatacaagcaaagttacgtgaggagctggcagcggttaagggtgaaccaacctatgacgacttccaggcgcgtctgccttacctcgaagccgtcttgcgagagacactgcgactgtaccccggccttccgtacatcgaacgcgttgcgactgtgcccgacagcatccctctgggagaacctgtcaagctctccaatggcgaggtcgtaagccaaattcccgtccttcctggccaggtggtcgtcatcccatgcatcgcgattcatcgtatggactccgtgtgggaggatcccgatgtcttccgacctgagcgctggctgaaggaccttcctgcaagcgagaagctctgctccgggtgggcgaacaccctcgccttcagcgacggcccccgcaattgcgttggttatcggcttgccatcttccagtacaaggtcatcctgacctacctcttggagaggctcaagttcggagacgccggtatggacatcacgttgaagatcgcttccagtctccaagcgtgggtcaaggaccgaccggagctcggaggctgcctcccagtaaacgttgatctattgtag

SEQ ID NO: 409 - DNA, 1524 bp, Dichomitus squalens
atgacagccacgatctccgtcgtgtttgcatgcttaattgctgctatttggctcgttctccctgccagcaggccgaagcggccattacctccaggtacgcatgttcccgtcttgcgattggacggggactcacggcctcgactaggtcctccctctacagcaaaatccgctgaacatccatggaaggtttacgcgacgtggtccaatactgtcggtcctttggttaccttggggacatcctcgcggcccatcgtagtcatcaataccacagaagctgtgaccgatttacttgagaagcgcagccacttttcgtgcaagccacgatggcccatggctgagctgctgggacgtcagaagaacgtcggatttcagtactacggagaacgtttgaagcgttcacgcagagtcttacacaacgcgctgaacactaccgcaattgggaccacctggacaggcctgctgaactcccagtcggtggcattacttcaggctttccttcgttccccagagacattctatacggacgttggcgggaacatcgaagctctggtcgttctattcacatacggtaagaagccagatgcacagtacacttccatggcgagagaggtcatgcaccagactgggatcgccctgcaacctggccgatgggccgtcaacttttaccccgcgctgatgtacgtccctgcgtggttccccggtgcgggctttcagcgctgggcacaagacgcgaaagcggccttctatcgtctcacaagggagcccttctaccatgtcaagaaagaattgtcgcaaggcaatgctccgttgtccttcgtgcgcaatgccctcgaggagtctgagcagacgccggaggaagaagatatcattatgtctgcagccggcagtctcttcagtgcggggacagataccattactacggccgtactcactgcgatactgctcctgactcgccatcctgaggtgcaagcacgcgcctatgaggaaatcaagacggtggtagggacggatcgcctcccggaaatgcacgaccgcgcctctctcccttacatcgactgtgtaatacaggagattcacaggttcaaccctgcgatcccactggtcacccacgctaattcggaagaggacgagtacctcggttatcgcattcctaagaagacatggatcatggcgaacgtctgggcaatgcttcatgacgcaaatgactaccccgatcccgaagagttcaaccctgatcgattccttcctggtggaaccgggcccgcgcgcgacccccgcactttgatctatgggttcggccggagactctgtcccgggatgcatctcgccaacgcctacctgttcctggttgttgcacggactatcgccatattcgagcttcttccaccgatagaggatggtatcaccaagatgcccccgctcgacttcgccgtaggcttactgtcaactcctaaacccttccgcagcattctcaagccacgcggtaaggcggaggagctgttgggattgcacggtgaagattag

SEQ ID NO: 410 - DNA, 777 bp, Dichomitus squalens
aggctcgatgacctgaacattgctatcaaagaattcttcggaggaaagctttcctttgcgccccttgaagaccttcaacccacagcaatcctcgagataggatctggcactggcgcatggcacgtacgggctatacaagcagcagaggcattccctcaagctcgcgtggtcgcagtcgaccagaacccgataccgccccgccctctaccgtctaacatcgagtttcacaagctcgatatcaccaagggcttaccgtttgaggacgagaccttcgatatcgtgcacgcccgacttgtcttgatgcatgtgccaggggcgagagaaatccttcgccgcgctgtccaacttctcaaacccggtgggtggatcgtcgtggaagacccagacgatagccatatggtcgatcacgggaagccactcggaccgggcatgggagccttcgtaggagcgtggctcaacattctgcgctctcgcggtgcagagccctgttttggtcgttatctcgagagcgaactgaaggccatccactcacttgccgaagtgaatgtaaggaaggtcacaattccgatttcgggaaacagcgaagaccccgaggagaacaaactcgggctctcttggaaggtcaatatgctccgcgtggcccgtgacttgccgacgcgtttttccgatcagggtatcaccatggaggttgcggagaagcacctcgaagagttggtggatccagcgcgtagcatcacaacagatatgtacttctcctggtcccgtaagcgggtgtag

SEQ ID NO: 411 - DNA, 1941 bp, Dichomitus squalens
atgctcgcagttacgaggtcactcctcccaagcctgctggcgatcgtcgcagctcctggggtgcggtctatagcatgtcctgtacccgccactcctagcccatcttccttcgctgctaccgccttcgattacattgtgatcggcggcggcaccgctgggactgcgttgtctgctaggcttgcagagaacccgtctgccgtcgttggggtcattgaggcagggatattacacttgaatgaccccatcctcgacgttcccgcatcctccggtgttggcaataagacctacgattgggacttcgtctcgactccacaggtgaatgccggcgggcggaacctgtctctctcaaggggcaaactacttggaggatcgagtggaatcaatgggcttgcgtgggatcgggcatccgcaacggagtatgacgcgtgggcaaccatcgctggtgacaagagctggagttggtccggtctgcttccgtttctgcagaaggcggagaatttctccaagacgcctgccgacccgtttccgggaatcacccctgcggaagccgccgaggttgaggcagacctcccccacgtagacggcttctctgggcctatcgtcgcttcgctcaattcgctttatttcgacacggttacgaacgtgactgtgacgctcaacaaccttggcattgagaccaacgccgagcctcaaggtggcaacaccaccggagtctcgaacattcgtcttagtctgtaccgtacacagggtgtccgctcgtatgccgccactgcgtactactgctcgcacgccagtaaacctaattatcatgtccttaccggcgcccaggccacgaagatcatcttctcgaagacacgatatgggcttatcgccactcgagtccagttcatctctgacggacagcagtacactgcacacgcttcgaaggagatcgttctgtccgccgggacgatccaaactccacagcttctcgagctttcagggattgggaattccaccatactgaagagcaagaacattacgccgctcatcgatctccctggagttggagaatcattccaggagcactttttcgccgcggcgcagtggcagctccggcctggtgtacaaacgttcggtattcttcgtaataatgcgacatttgctgctgagcaacaagcgcaatacgctgccaaccacaccggacttctcgcagcaaccgactccctgacggctttcctcactctgcaggacatcgtctctcaagatagattgcaggaactcctcagtatctttgaccaggaggcaagtgcgccgggtctttcgggtctacaacagcagcagtacgcgctgcagagggagtggttcgcacagggcaacgttcccgccgtcgagcttatcctgtggagtaaagggctcatcaatgtcgagcaaggagagagctatgcggtcatacttggcggtctcatgcatcctgtgagtcgtggtagcacacacattgcttcctgcgatccgctcgcttctcccgccatcgacccgaagtacctgagtcaaaacttcgataccgaggtgctcttggacgtcctcaagttcctgcagaagcttggacagagcgctcctttctctgatttggtgaccgttcagacgaaccctgatcccacggcgcaaacagacgacgaactccttgcatacatccgcgcgagctccgctggtggagaccatctagttggcacggctgccctggctccacaagcttctggaggtgttgtggacggctcgctcaaggtgtacggcacgacgaacctccgtatcgtcgacgccagtgtcttccctatccagatcggggctcacagtcaggctactgtctatgccatcgcggaaaaggctgcacagctcatcgcggcggcagagaatgcagaccagtttgtctcgcacccgccccaccctcgttcaccccattga

SEQ ID NO: 412 - DNA, 1017 bp, Dichomitus squalens
atggcagagtaccgtcaactcggcaagtctggccttcgggtctctgtccccatctacggtggcatgtccatcggaaacacgcaatggagtccatgggtcctccctgaagaagaggctctcaccgttctaaaggctgcgtgggatcaggggatcaataccttcgacactgccaatctctactcgaatggtgattcagagagggttctcagtaagttcatcaacaagtacagcattccgcgcgagaacgtcgttatcctcaccaaggtgttcttcctcgttcacaaggatgaccctacctccgtcaccgtccttcggccagatctgaatggtacccgtgactatgtcaaccagggtgggctctcgcgcgccgcgctcttcaatcaggtcgaggcgtcgctcaagcgtctcggcacgtcctacatcgacatacttcaggtgcacacgttcgatccgactacgcccattgaggagacgatgaaggctcttcacgacctcgttgaaagtggaaaggtgcgatacatcggcgcatgcaacttgcgtgcctggcagtttgccgagatgaatcgcgttgcggacgtgaaccactggacgaggttctcgagcatccagatcgagtactcgctcttgtaccgtcctgaggaattggagatgattgcgtacgccaactaccgtggcattggcgttattggctactccccgctccttgatggtcaccttgcgcgcccgctcgatactgttactcctcgctcgaagagcgtctctgggacgttcttcgaaaaaccccggcgtgactccgacaagaagatcatccagcgcgttgaggagctcgcgaagaagaagcaatggacgatgagtcaagtcgcactgtcttgggtggcgtcaaagatcactgcacccattgtcggtgccaactcgcccgagcgtgttgctgagagcgtcatcactggcaaggttctctctgatgatgaactcaagtacctcgaggagccctatgaaatccagggaccaaggttctaa

SEQ ID NO: 413 - DNA, 1095 bp, Dichomitus squalens
atgtctgtccttaacgtttcctccgtccttctcctgctcttcttctatctcttccctgcaatcagtgccgcagcaccccaccatcccgcaccccggcagtacactacgtcctctcttaatgtcggcaacggtaccactctcgcgtatttagatagtggcgcgccttcttccaggacgtacaccactatttttgccattcatggcatgggtttccagagtcctgtctgggagaaggtcctcgatctcgcgcccgcatacaacacccgctttgttgctatcaacaggcgcgactacaacggctcaacgccgtacaccgccggcgacctgaacgtgctccagaacggcaccgtgtctgagcagacggcgttcttccagcaacgcggcgaagagatcgccactttcatcgagctgttcatcaagcagaacggccttcctgctccttccgcagacgggaagacgggtggtgttgccttgttaggctggtcgcttggcaacgcgttcggcgtgtctacgatcgccaatatacagacctacgctacttccacccagcagacgcttgcgaagtatctgcggggattggtcttgcaaggttcatggtccccgcagatcgacacgagcatcccagctgcggaccgtcagcccggcttcgtgcaatggatcactgcctacttccagcatggagacctttcgacgcgcgacgtcaacgtcctcgaatacgtcttgccgagcatcacgcacgttccgagcgtgttttcgtttacaacagatcagctcgctggagttacgaaccttgctgccgcgagtggcagtgataccttcatcgtcggctataaccaggctgcgctcctcccaacataccggaaggccttgttcaacaagacagtccgcgccgccatcccactcctgaatgtgctcgagttcaccggcgatatcactgccaacttcggtatcgtcgcgctctggcagatccaggatgacgatgctgcggctggcggcggctttgtgaagacggagatcctcaaagggacgaaccatttcgttcactgggatcaacctgcactcgcgttgagtacctacctgagtgtcttcgattga

SEQ ID NO: 414 - DNA, 717 bp, Dacryopinax primogenitus
atgctttggatctggcttcacttgctgcaatgcaatgtatcgaaccaatacaagacctgcgatgaagacaagatcaacaagccctggagaccgctacccgccaaccgcgtgacgttcggtcaagcccaatttcttcgctgggccctggtggtcgtctgcgccctattttcactcagcttcgggaccgatgtcgccgttgttagcctcgtgctcaccctgaccatgatagtttacgatgaagtcggccttgctgggcattgggctgggaagaatatctgtgcggtatatgggtacgggacctttgagatcggcgctacgaagatcatgggcgagacttcggatttggacgccaaggcccagctctcggtggtcttgtcagccatgatcgttctgacgactatccacgtccaggacttccctgatattgaaggcgatgctgccttgggccgcaggaccatcccgatcgttttccctggtgcttctagaatcgttacacccctgcttatgttgggatggaccgccgtggtggtcaacgcctggaagctaggtcttgtgccctcgacgctgatgtacaccctgggacttgttgtcgcggcacggatttgggcggaccgcagcacctcaggggataagacgacctaccttacttacaatatatggctaatctgtgcgcaccttctacccgctaacgcccgcttcggtgtgttgtcgtggtaa

SEQ ID NO: 415 - DNA, 1647 bp, Dacryopinax primogenitus
atgccattgaggatattcgacgtcatcatctctcttctcatcgtctttgtttcccgctttgtcctcgttcgtctctgggcatggtggcaggcgtatcagcttgtcaaagatgttcctggcggcgttcactggcatttccaagacccggagtcccaagttgggggtcagctcccacatttgccattgggaggcatcggagacttccacgcgaaatggttgccctattccaagactcgaacaagcgtcatagtctcgattcccttctggcgtcctgttcctatgttctgggtctgtgacactgttgcattgaaacagattgccaatgataggcacaccttccctaagcgtcccgagacgtaccaggcgatcatgttctacgggcccaatgtggtatctgcagaagggcaggactggaggcggcaccgtgacgcaacgaaggctgcgttcggagaatcaaataaccagcttgtctgggcagagagcatgcgcactgtgaaggaatggttcgaggccctggattcaggaaagaaagacatgcagggtgccgtgactcaagaagttcacggggtgatgactcggcttgctctcttgatcatctccgccgccgggttcggaaggcacgtctccttcatggcggatgaacatccttcccctcctccaggctataagatggcatttcgtcccgcccttctgaccgcagtccataacatggcgctaaaggtccttgcgccacgttgggcgtactcactgccgatcgaggtgctgaagaacacggatctggcgtattcggagctgaaacggcatttggaggagatgatcagccgaaccagagcgcagttgatgggcgacagtggtcaggggagaggacaggctgatctcttcaagcggctgatctcggcgaacgaagtggaggaagagggcaaggcgaagctgaatgatagcgagctgctatccaacacatacaccttcctccttgctggtcatgagacgaccgcgaatgccctttccttcgcctgtgccctgctcgcgatgcaccccgaggtgcagcgtaagcttcaagccgaggcggacactgtatggccagacgggctgcccgtcgacggtgcagagtcctatcgggaggatgtcaacagtctgaagtatgctgaagctgttttccgggagacgacacgtttgttcccagcggagacgaggttgagcaagatggtctcacaggacacacgtctcaaagccaggaaatggggcaagaatggtaaggaagaacattacgaggttgtcgttccccagggcagcacggcatggctggacatctgggctactcacatgagccctgagtattggggcccggatgtgaacgagttcaagccggagcgcttcttcgacaccgacacctacaagtggcctcgagatgcatacttgccctttatgattggacctcgatcatgcatgggccagcgatttgccgagctcgagggcagatgcgtcctcgcgcatatagcaagtcagtacgatatcctccttcctccggagctggagaacgcaagtgaagaggagaagaacaagaagctactgagctgggatatccgggttgcgttgaccgcgaaggatgtcacactgagatttgtcaaaagggccaatgctgtgtag

SEQ ID NO: 416 - DNA, 1314 bp, Dacryopinax primogenitus
atggctcgcgaagtagaggagctcgatgcgctcctatcccttctcacagacgcagtcggcgtggtcaagtctgcctacagcgcgcacgcccgtcaaccggagctggaggacgctgccggtcagcctacgcagctaggtgcgagcgaggagctgcatcaggctaggaggaacatcagttccgcgagccggaggacgctcctccttatggctaacagcgcttttgagacagcagcactgcgcgtagcggcaggagcctgcgtggcagatcatctcctcccccacccttccggcctgcccatcacagacctagcagcgaaatgcgatatggaggctgacaagcttgcccgtgtcctccgcctgctcgcgtgcaaacacgtatttcgcgaagtcgctccgggagtgtttgcgaatactcccctgagcacgcggttagcccggaaacatgggatgtgggacttggtgaaccacataacagacgaatgcttcaagtcctccgcctatctgtacgacgcgctcgccgcacccgtgttcaagccccctttcgcccatgcgtacaagcacgacgccgggtattgggcgtacatggctggagttgacaaaaccatgggagcacggtttgggagggcgatgctgggtgttgacatggctgaaatcggaccgttactttcccacttcccgtgggagacacccccccccggaacgacagtgtgcgacgtcgggggaggggtaggcacagtgagcctcgcactggccaaccggttctcgcagctcaagctagtggtgcaagacacgcccaatacactggcccaagcccgtctagaatggaaggaaacggcgccccaagtggtcagcgaggggagggtcgacttcctccctctggactttctgacccaagccccgaacgtggggtgcgagtattattatgtgcgttgctgttccgctcggcttaggagcgatgagcggagcgaagctgagcaaaggcagctcaagcatgtggttcatgattgggcggacgaggaggctgtgaggctcttgaggaacgtaaggcagtccatgggcgctcattctcgcgttctgatacacgagttcgtcatccagcctctcttccctcctcccaccgaccctcgagaaggaacaacatcatccgccccttccccaagcctggcacccgacagctcagcgctacacgcccaccacctagacctgacagtcctctgcctcctagggaccaaagagcgtacgcagggggagtttgagcacctggcgaggaaagcagggctagggtttgtcaggctttggaacctaggagagtag

SEQ ID NO: 417 - DNA, 393 bp, Dacryopinax primogenitus
atgactgcggagcacgggacgaagtatttgttgatccatgatggacctgaggcggaacggctcaatcggcaacatgagcgcctagaagcactcttcgatcaccgacttttgcctgaggggcttgagctgaaagcggatgatagaatgctcgactcgggtactgggactggcatttgggtctgcgaggtcgcctcgatgcctactgtaccggagacagtacacatagacgggatcgacatcacctcgcatcttttcccgatctcgtttccccccaacgtgcacttctcgatcgagaacatcctccacctgccagagtcggcttattccaagtatgcactcgtacatcaacggttccttgccgctgcgttcaacgggatcggatcgtctgcttaa

SEQ ID NO: 418 - DNA, 825 bp, Dacryopinax primogenitus
atgactgccaaggggaacatcacaaaatatgccctcgtgtctgacgattcggaatcgcacaggctgaacaagcaacacgaaacagctaagagtatccttcacgggcgattgctccccgatggtctggatttgcaggatggcgatcttgtgttggattcgggcacaggcacaggcatctgggcaatcgacgttgcatctgatctgccgaagagtgtccaaatacatggcatcgacatcaccccacgcctcttccccgcttctcctccgtcaaacatacagttctccgtggagaacatcttgacgcttcctgaatcataccatggaaagtatgccttggttcatcagcgctttcttacggcggcgtttgggggagaagagtggaagacctgcatcaagaatgtctatgcagctctccgaccaggcggctgtttgaaattggaagagatccatggctacctccaccctgatacattgccctgtatgcctcaggtgcaggcgttcaccaagcacctcgaaaagctaagggggatcgacttccaggctgtcccgaagatccacgtttggctattggaggaaggatttgagagtgtggtgatcgagccgaagaggtggttctatggccccgggaaaccccatgagcatgtccgggataacctgctggttgcatggggagctgtgaggcgggccacaaagcaagctgcgacggactggggaatgacggacgaggagtgggacgagtttattgctcatgtcgacagagatctcaaagagaacgagtcgtattcaatagtatacagcttcactgcacggaagcctcccatttag

SEQ ID NO: 419 - DNA, 1680 bp, Dacryopinax primogenitus
atgctcaccgacgccgctctcgctctcttcctaggctatctctgctacgtcctgttctcccgctttctctccctccgccaggtgctcgctctcttccccaatgtaccttccggcgtccatctccagtggacacatccgcagttcttccttgctcctgcgttgcgacactatccgcaatgggacgtgggtgactacagagcacaaggactcccatacgaaaaggcaggagtgagtattatagccgccacgcctgcgttctggccccaccccaacgtctggtgctgcgaccccgccgcactcaaagtagtaggtggcgaccgcgacctcttccccaagcagaccgagctttaccacgtgataagcttctacgggccgaaccttgtctccaccgaaggcgcggaatggaagcgccatcgggatgcgtccaaagccgcttttggggaggggaataaccagctcgtgtggagggagagcattcgggtcgtgaaggagtggtttgacgcgcttgatgttcagcagagcggggggagtgtagaggtggacacgcatgagcatatgacccgactcgcactgctgatcatcacctcggccggatttggtcggtacatccctctctccgtggcctccgcccccgcctctgcacccagcacctcctcagggaaggatgcgatttcccgcatcccgccaggctttacgtacccttttgtctccgccctccttacctctgtgagcaacatgaagttccagaccctgcttacgcagtatccgctgctcaagcccctcccctttcgtgcgctggaagatacgaaaactgcgtatgcggacttgcatggctatctccgggggatggtcgaggagactcgggcgcagatggctgaggaaggagaggaagagcgagggcgggcgaagggcgagggcggggaggcggatctgttcaagaggcttattcgggcgaacgaggatgagggagatgggacaggggatactgatgttcatgcggtgcaggtcttcctcctcgccggacatgagacgacagccaacacgctcgcctttgcctgcgctctactcgctctcaacccgtccgtgcaggccaagctgcgggaggaagcggattccgtctggccttccgtctcttcgctctcctctgaaatcgccttccagagctatagggaagacatgccccgcctgaaatacgccgaagcgactttccgcgagactctgcgtcttttccctgccgaagtgcggatcacgaaacgcgttgcaagagatacggtgctaagaggaacatatctcaagaccggggagaagtatgatatgcccgttcccaaggggacggtcttttggatcgacatctgggcagtgcataggatgaaaatgtggtggggcgaggatgcggaagagttcaggccagacaggttcctcgatacagcagagtataagtggccccgagacgctttcatgcccttctccctgggagcacgcgcgtgcataggcgcccggttcgcaacgctagaggggatgcttattctgtccctccttgtgcgggaatatgagatctgcctgacgccggagatggaggctttaccggtggaagaacgcatgcggcagatgctaagctggaagattggggttgccatacaggccaaaggagcgaaagtattgttgaagaaacggaagtag

SEQ ID NO: 420 - DNA, 774 bp, Dacryopinax primogenitus
atgtcctcccatgggactgatgaagagacgaagtatctactgggtaatgcggatacacgtgagagcgaccgactagataaacagcacaggatcatccaggaccttgttggtcctcttcttccggaggatctcaagctgcgaaaaaattatcatgtcctcgattcaggagcgggtaccggtgcatgggcactcgagctacactcgacgctcaacccacagacgtacgtcttcatcacaggcatcgacatcaattctcgattctttccggccagcccgtcaccaaacgtcaactttgtcgtccactcaatcatggtcctccctcccgcctggaccgagcgtttccggtttattcaccagcggttcctgagcgccgctctgtcgtttgccgactggaggatcgtcttcgatcaaatgcatcgtgcactgctcccgaagggctgggtcagggtggaagaatttagtgccacattgtgccctacgaacgtctccgcccaaaagctgccttacagccatcagctgctggattacgccgggaaattcgccaagaaggcgcctcttcgtatgggccccggcgacgagtacagggggatgcgggccaattttactaatatctggctgtatatacgggacagcatgaaaggccatcctggcgcaatgaccgatgcagacttcgaatcgttaatggcgaatctaagcaaggagctggaggagaacgacgtcggctggaacctgcacattgtcactgctcgtaagccgggaatcgcacgtcattga

SEQ ID NO: 421 - DNA, 729 bp, Dacryopinax primogenitus
atgaacgatgcttccacgttgcaccgctctgctcttgaaccgccctcaacgaccagcatgccgtcctacacgattgtcggaacgccgttctctaccttcacccggagtatcactcttggtctgcagcacaaagacatcccgtataagcaagtcgctaccacaccgcattccgatgtcgcatacaagaaccatccctttgggatgctgccgactctgattattcacgggattgggaacagcgatatctacctctgcgagagccaagcaattgcgaggtacattgaccgtgtggcaccgttgccgtctctcgacttggaacccggcgaggcagggatcgcggtgccggagaagatgtgggagtttgtcagtttggctgggtctcagggtttcccggccgtcgagatcaaggtggtcaagcaccgcgttcaagcgattgacgacggcaagcccagcgatgccgaactcagggagcacatcaaacacggagtagccaaccttaagctcttccttgcacgtatggaggcgcttatggctcccgaaggctatgtctacgggtggaaagtgacctgggcggatttcttcctcttccctctcctgtcggacctgaaggcgaccccggaaggagagattttgagcccgaggatgctcaagtggctcgcgattatggaggaactcaaggctgtgaaagatacgactgcgggcacgctgtctgttggtgggaggccgtag

SEQ ID NO: 422 - DNA, 588 bp, Dacryopinax primogenitus
atgtcactcggcttaactgagtattgtccagtctacgcgccgttctttggtgcagtgggatgcacagcggcgatcagcctatgttcgctcggtgctagctatggaactgcgaaatccggagtgggaatcgcagccatgggtgtacttcgacccgacttgatggtgcgggcatctgtgcccgtcgtgatggccggtatcatcggcatctatgggcttgttgtatcagtcgttattgccggaggcctggggtacacgatgcccctatataccggctttgtccaactcggcgctggtttctcagttggtctgtctgggttggccgccgggttcgccattggcattgtaggtgatgctggtgcaagagggtttggacagcagccaaagatcttcgtcgggatgatcctaattctcatcttcgccgaggtgcttgctatctacggacttatcgtcgctctcatattgaccactgctgcgacttctggggatgtcgctaacgctctccggaggaaggaggatatcgtactgacttgctatatgcgcgaggacgcatctgccctcgagctcggcaaatcgctggcccatgcatga

SEQ ID NO: 423 - DNA, 3075 bp, Dacryopinax primogenitus
atggcatcctccgtcgcatcccactcccgccaaatatcccaaacttcattcacaacaacctcatccacaggtcaatacgacgactacctcacagtacctcaacaatacgactacgcatccgagtcctcatacggttattcctctccaggggactctccttccccagcagcggacaactcccccgaccagccattcctcgaaggcgctgtatccgtccgcaggagcttgagcgcttcttctgcccagacggggaggagagcgagacacgtttcccaggcatgtgatacttgcaagctgaagaagacgaagtgtgatgggggaaacccttgcacttggtgcgagaagaataattggaaatgtacgactacgagtaaggataatcgcaagacgccgagtaaggcttatgtccagagcttggagagggaagcggcgaatttgaagcatcgggcagaggcgagcgcgcggttggcggaggggttgaagcagaagaatatcgcgctggaggaaaagttgcgcaatgcgggattgtgggatgggttagggacagaggggaagctgacgatcatgattccccctgctactgctgctcctaggcaggaaggggaagacgcagagttactaggcatgggggagaagctcgttcgtgatcgatctggctctcttaccgcttacgccggtccgtcccccttggcgcatctagcgacatcccccccgcccggcatgccctcccctcccctcccagacccccagcagcccaaactcgggtggagcagtataaccctctcccccgaaatacaagttcaagccacgcgcaacttcttctccttatcagggacagagtacctccctctcgccgcccaaaccctgcacatgctcgaatggggcctctctccctcttcccccggtgtcggtgtgcaaggccccctcacaccagcatactacaattccttcatggcgaacgcccttctcttcctacccccacacactgtcctccccagcgcgaaacaccagtttgcggccgcgagccagcacccgcccatcttccaacaccagtctctggggaacgtgctctcccttggcttgctggcgcagttctcggctcaggaaggggagtacgaccttggctggcagtatgcgggtatggccagccggatgatgcagtcacttggcctgcacctggatttcgacaggaaggaaaaagatttcgcttgggcctcgctttcgacgcaggaaaagcaattgaggaacatcgtctactggatcgtatacattcaggacaaactgtggtacctctgggtaggacgaaccactgctgtgcaggataacccgcgtatccccctgcctgaagtagagggggagaacaacgagcccatgttggtcttccgcgcgctgtgtcagcttatgcgcacagcggggtgtataatgcctgacgtatacggccctgacctcagtacagtggcaattgacgcccaccggcttgctctagacgcgtggcttaacagactcccggacttactgaagccaacaccgaaagcgatggacactgcctccataagcctcaggcaactgcatatgacctatcactggctgagggtcttgcttgatcggccgtattataaaccgatcacccatcaactggcgcaggaaacgggggttgggaggacggatgctagcttgaggcagatcatggttttgcttggaccttgggattcgaaggttcaggtgaacaagagcttgcaagctgctgctgctcctggcgctgctgtacccgctccactccctttaacgccactgctagcgcaaatcgtgctcaccaccggcatcacatggctgcacagcgccgtctccttccacaaattcagcccaaagcgaaaagcagaaggagtagagaaagccagagtttgtttgagggtgttgcacgaagctggccagagggcgtttggggggatgttgaggaggttgatgaggcggtattttagtagtgttgagatctcggaccgggaggggctggggatccaccttcgtccagttccggggttactcccccccggggggataacggtgcctgtgctgccacaagtacagatgtcacctccggaagaaagtttcccaacttcctccactccgggccaaacgctcttcacacaagaaccgggctcgttcgacccttctccctcgagcacgtcgctgccatcactgccagctcacactctctccttcccccctgacttgctctccccacctcaatactccccttcccccaactctgcgagcccgatccccagtggtagtgtgctccatacgccgctgtcggggtatgcgcagctccaaggccaggggcaggggatggggcaggggcaaggactggggatggggcaggggcagggacaggggctggggtggacaggggacgcgaacagtaggatgatgcggtttatgcatgagtatatgagtgggagcttgagtggccatggctcaggcgcaccggggggcgcgggggcgggtggggggccgggagtgggggaggaggctggggcaggggaggaaggagaggggatggggatggggatgggggggatgaacccttatgttccggaatgggtgcagcagcagcagttgcagcatgcgaatgcgaatgcccacgcccacgcacatgcgaatgcgaatgcgcagggccaacaagcgcaaggacaaggccaacaagcgcaaggacaggcgcaagggcaaacgcaggggcaagggcaggagcagcaatccggacaagaaggcgaaccgatcaactacagcgttttccaagaacctgaagactacagtatggacggcatcacccccgagcatatggggatagggatgaacatgcctatgggcctaggtccggggatgagcgggatggacctgggcatgggcatgggcgtcggtatggaggggataggcgggatggacatgttagatccagcgagcgcagagttcaggcagcattatgggcagaagacgatcgtccctgaccggcttgatcggctggatcggcttgatcggcctcagagggggaggagtccgtgggatctgagcgcttag

SEQ ID NO: 424 - DNA, 1044 bp, Trichoderma Virens
atgactcaaaaattgacttctctgctggttactgccttgactgtggctactggtgttatcggtcacggccacgttaataacattgttatcaacggcgcctactaccaaggctacgatccaactttgttcccatatgaaccaaatcccccaatcgttgttggctggaccgcatctgatactgataacggtttcgttgctccagatgcctaccaatctccagacattatctgccataggaacgctactaacgctaggggtcatgcttctgttatggctggctcttctgttttgattcaatgggtcccaattccatggccacatccaggtcccgttctggattacttggccaactgtaacggtgactgcgaaactgtcgataagaccactttggaattctttaagatcgatggcattggcttgatctccggcggtaatccgggcagatgggcttctgatgtcttgatcggtaataacggtacctgggtcgttcaaattccagctgatttggagactggtaactacgttttgaggcacgaactgatcgccttgcattctgctggctccgttgatggtgcccagaattatccacaatgttttaacctagccgtcactggtactggttctttgcaaccaaccggtgtcttgggtaccaagttgtaccaagagtccgatcccggcatcttgttcaatatttacacctctccattgacttacaccatcccaggcccaactgttgtttccggtttgccatcttccgtcactcaaaggtcttctaccgctactgctacttctatcgctactgttccaggttctgtctctaccggtggtacttcttctaagactactactgtcccaagatctacctcctccgctactactagaagatcatcctcttctgccattactacctctgctccagctggtccatctcaaactttgtacggtcaatgtggtggttctggctactccggtccaactatttgtgcttccccagctgtttgttccactttgaacccatactatgctcaatgtttgactagataa

SEQ ID NO: 425 - DNA, 2091 bp, Trichoderma Virens
atgaaggacactgacattgctgttggttacctattgcaaggtaaaagagattggttcactgctgccgttcatccatctccatcattgccaaaggatatcgccaggaccttgtctcgcaatactactttgaaaatgccaatccgcgttttgttggctttatacccatgctacggcgctagattggctggttctggctcttgcttacaaaaaggtaagggtaaagctggtggaccagttgtcaggatcactccaaacgaattgcatttctctgaccccgagttccattccgaaatttactctggtcacaagaacccaaaagacaaatacgctcccttctaccacttcactggcgctactcaatccgcattcgagactcacgatcataagttgcacaattccaggagacaacccttgatgtccgccttctctaagaggagcattgtcgctatcgaacccctgatcttggaaaaagtcaatatgctgtcccagcgttttgaaactgcttacctgaacaagaccgtcattaagttggactccgctttcagcgctttgactgccgatattacctctcaatacgcttacggtaggtgctttggctatctggaagataaggacttcaaaaacgacatccgcgaatccctgctggcctctttgactctatttcatattgtccgcttcttccccattgtcatgaagggcgctaaggtcttgccattcagagtcgtccaatctttgaaccctatgttgagcaaagtcctgggtttgaggaaactgatcaacgctatcactatcgaggaactgcacactatgaagcaaggcaagacttccgacgcaatgttgattcaagtcctgaataacccctctatcccagaatctgaaagatctctagagcgtctgaacgacgaaggcttcgtttttatgaacgctggtaccaccactggtaaaaccttggctttcatcatgttccatctgctaaaggacaatggcgcctactactctgtcttgcaacaagagttgatcaagactttcccagaaggcatggaaaggttgacttggaaggacttggagactttgccatatttgaggggcgttatttacgaaggtctgagattgtctattggtccattgactaggttgcctagagttgctcccactgaacccctaatttaccaaggtagggctattccaccaggtaccggtatttctgaatgtaattactttctgcatatggaccccgttctgttcccaaatcccgccaagtacctaccacaaagatggattaccgctgaagaaaacggcgagaggttgcaaaagtacattgttactttcggtaaaggtacccggcattgtttgggtatgaaccgcttgttgttcaacaaagtcaccaccccggagttggctaaagaactaaacagaggttcatccgaccatgaaatgtctcactcctggttaaaagctttcatgccaaggcaggctggtcaggatttgttcgttaacaccccattcactattaaaccacccgctactttggccggcggtttgggtcaaaactctattcatgcttcctttttgcagtctttggacgaggatttcaaggagtactacaacttgtctttcgcccataagccacccggttacactgccaaaatcgctgatatttgcgctgctccaaagagatccgatgctcaaacctccccatttggtttaggtttgtacccagtttacaccaactttcacactaccgtttgtgtttctggcattgagaacgtctctttgcaaggctacgatgatgcctggtctgtgattaagtggatgtactcccataacttggagctgaacactttgtctggttctatctcaattggtggtatctccgctggtggtcatacttctgaagtctgtcaccagttggtgagagatactagactgctgctaaaactggacaacattgtccctaaatacgatgcccaacaaaggggtatcgagaaccacttgaggttctttgcttctcccattgatggcgatctgcgtggcgtttgcaaaactttcgttgctaccgctaaatttgatttagtttgggacaagtcttag

SEQ ID NO: 426 - DNA, 960 bp, Trichoderma Virens
atgaacgaagaaaagaagttgagatccgattctttcgtcggcactccatctgctgtcttgagagaactggatgttaccgtcagattgctgaagtctaacgccattggtttcctgtttatcttcatgggcggtttgttgtccagggttgttcagaccccattgtctttggctaagactatcccattgttgaccgagactgccatcttgtggatcctatgcaactacgttttcgacatcgctaaccaaacctcttctccagacgaggactacattaataagccacacaggccaattccagccggtttgattaccattaagcaagccaaaaccagatgggtcttggcatggactttgggtccagttgccttgtatagactgtttggtgtctggccaatgttacacttgctgcattgggaagtcctaattaccgtttgttacgtctggcccaagtggttctcctggttcatgaggaattactttgcctccttctcttactgtatcctgggtaggttgttgaactccgtcttggccaggaatgtcgaagcttggaacatctccttcgctattgattgttccatcttcgtctggtttatggccactattcacattcaggagttccacgacctggaaggtgacagaaagtccaagaggaagactctaccaatgttgctgtctgacagaggtattaacgctctgaggaccggtacttccttgtttgtcttgacctttgggacctgcttgtgttatatcggttacaaggtcatggacaaggacatcaagatcgctccaatcaccggcaacccattgatgttcgttttcaataccgaaaccgcctctttgatgtctaggtactactacgtcgcttgccaacatccatccgatgtcaccctgtcccatgatgctgaaggtaaacagatcatcgataccttgtgcaatctgttttttggtgttgttgtttga

SEQ ID NO: 427 - DNA, 690 bp, Trichoderma Virens
atgggctttactgacttgttagctgacacaggcttagcggtacttaacaactggttgctaacccggtcgtacgtaaccggatatgctcctacacaggcagatgttgcgtgtttcaaagcactccaaggatcaccggactcagcaaagtatccacatgcagcgcggtggtataagcatatagccacattcgaggatgagttcagtacgctatcgggagacacaactaagccgtacacagcatatggaccagatttcgcagaggtgacacttaatgcaaccaaagtcccggccgcagaagagaatgacgatgatgtcgatctctttgggagtgatgatgaggaagaagacgctgaagccgtgaggataagagaagagcgcttagccgaataccgcaaaaagaaggaaggaaaggcaaaaccagccgccaagagcgttgtgacccttgatgtaaagccttgggatgacgaaacagacatgatcgcattggaggcagctgttaggggaatcgagaaggatgggttggtctggggtcagagtaagttggtcgccataggcttcggaattaaaaagctgcaaatcaatctagtcgtcgaggacgacaaggtgagcacagacgagcttcaggaggagatccaggagtttgaggactacgtccaatccacagacgtagttgccatgcaaaagttgtag

SEQ ID NO: 428 - DNA, 1794 bp, Botryotonia cinerea
atgccctgtcacgtcttgcaagttgcggcaggtacttacgatcttcttcacggcatcgcaaccacaaccccttggtctgccagtatgatttttttattacttttgaccgcgttctttggctcatatgagagtttgatcagtgcctcaccgctgaagtcaacttgccgctgcttcccaggcgattcttgctaccctgatactacagcatgggacgccttaaatgctacggttggagggaagctcattgcaacagtacctatcgctgcagtgtgtcactttgatcaatttgtggcctatgacgaagcagcatgtgccaccttgagggacaactggttctatcctgagacacatctgccttctccgtcttctgccatggcctggctgttcacaaataacacctgtaatccgttcctttcatctacaaccccatgcactttgggcaattatgtgagttacactatcaacgctaccacaagcaacgatgtgaaagaagccatcaattttgccaattcgaataatatccgtctggtcatccgcggtactggccatgattataatggtaaatcgacaggagccggtgcactctctatctggacgcattatatgaaattcatatctctcaatgagtcgtatgagtctcaggcgtacaccggaaaatcagtagttctcggtgcaggtatctcatctatcgaagcttacagatttgctgacgcgaacaacggcttgattgtgggagggaattgtcccaccgtctccttggcagggggctacactcaaggaggagggcatggtccatttgcgaccaagtttggtcttgcagttgaccaggttttggaatgggaagtggtgacgagtgaaggagagctattgaccgcaagtcccacaatcaattctgatctctattgggcactctctggtggaggcggagggacctacggcgttgtattatcggtaacggtcaagtttcatccaccaacaagcatactatcttcagcaactttgcagtttgctcctccagccacagggaacgccacagcatactggaatacagtcaaagtgtttctaggatctctgccaagtttggtagatggtggcttgcagcttggatggactcttacacccgaagttttcttgatctccccagtcacgggttttgacgtcgagcaagccaagattgacgaactttttgcgccaacgatatcgtcccttgaagcagccaatatttcgtatgcttacacttcttcggtagccaccagctttctctcatattacgagtccggtggcttcggcgccaatgtctcgaatacaaaccttgctggccgcttactccctcgttcaattgtccaaaacagcaccgatagcttcatctccattctccaaacaatcgtcaacaacaagcttatttttgccggcgtcaccttggatgtaaatacacctgtagtagccaatgcgccagccatctccataaatccttactggagacaaactcttatgaccggcgtcttcggcgcctaccttgattataccgacatcgaacaaggcttccaaacccaagacttcatgactgataccatcatgcctgccttggccgccttgacgccaaacggcgccgcgtatatcaacgaagccgattttcaacagccggactggcagaatgtgttttatggtgagaatttcaatcgcctgagtgatataaaagcgaagtatgatccccggcaaacattttacgcgctgggggcagtggggagcgagaagtggacagaaagatcggatggacggctttgcagggtttag

SEQ ID NO: 429 - DNA, 879 bp, Botryotonia cinerea
atgtcacagcttactagaaatatcccgagccttcaactaaagaatggctccgcaattcccttgcttgcttacggcactggctccgttataagcaaagcagcggatgacggcgccactgacgtaaaaatcgtcgaacacgtccaatcagccctcaaacttggctacacgcacatcgactgtgctgaagcctacaacaatgagcgtgaggtcggcgtcgcgatccagcagagccaaatagctcgcgagaagctcttcgtgactacgaagacactgggtttccagcccattgctcaggcgctggatgccagtttgcagaaactgcagctcagttatgtagacctctacctcatccacatcccttggctcgagcccacgcgctctctccgtgacgtatgggccgagatggaagccgtcaaagcttcgggaaaagcaaaagccatcggcgtctgtaacttcgccatttcacacttggagactatcatagccggtgcaagcgagatcccggcggttaatcaaatcgagtatcacgcttatctccaacaatcagagctatccgcgtactgccagaaaaacggtataaaggtagaagctttcgcgtcactagcaccgtggattaccgagggcccggcgaagggagtagtggcggagcttgcacagaagtatggagttggagagacggaaatttgcttgaggtggtgtgtgcagaagggggtgccagttgtgacgacgagtttgaaggaggagagggtaaaaggttatctaaaggtttttgattttagccttgaggacaaggaaattgaacagctgtcgagtgttggggcgagccatcatttcaggaagtattttgctgacaatttcgctggggaggataaagcatag

SEQ ID NO: 430 - DNA, 1641 bp, Botryotonia cinerea
atggcattaatacctgggcactatcttattgctgctgctgttagtggtatcgcagcccacttatgtgccttcatacacggagattggcacttgcatattcctcaggttatcttcactcattgtgctggctatgcgttacttttactcaggcttagatatcaagaattgagcatcatagactcgatccaggcatcgactgtcttatctgcatgctatctcttattcttgttcaccagcatcatcgtctaccgcgtcttcttccatcgattgcggaatttccctgggcctcgtcttgcagcagctaccaagctctggagtatatgggaaacaagagattccagaaaccatctgttgatgcaacggctatttgagcaatatgggccaatagttagaacggctcccaatgagctcacggtctttcatcctgaaggcgttgaactcgtgaaaggaggaaaaaatggaacagatcagtataacgagaagggtgtttggtatgatctaattcatcccaaaacatcggttgtgttcaaccgtaatccttccgagaatgccgttcgacgtcgtccttgggatcgagctgtttcacccgcaagtcttagaagttatgcggcaaacatagtagcccctgccgcggaagttctggaattcgtttccaatgcccaaggcgaacccgtcaatattaatgaacttatgaccggactcatctttgactttatgagtgtgatcgtcttcggtgaagtctctagcaaaaccgatgcagaggagcaaattagtacgctgcgtagactcaaaggggcactcattttactagcaccatgcggagatagtgtctggccagctctttttgccttcaactttcttcagtttttgaaaccggtcaaaagctggctaggtcttgtagagtcatgccgcgcacgtatgctgaaacgaatgaacaaaaaaacaagcacagtcgatgtttcaggctttttccttaaagatttctacgattcggctggggaaactagtcttgagaagcgtgagaatgcgctcctcggaaacactatctctgcactggttgctggtagtgacaccgcacgtgctgccatgattgggatattctatttcctgtgcaaaaacccaggaaatgcggatgaaatttacgaggaactaaaggatgttgatgaaaaagattcgacggtccttgcaggcaaaccaatcttgaatggctttataaaagaggctctgcgtgtagctcctccttcgatgactggtcttgctcgaatcataggtccacaaggcttatggatcgacaataccttcattccaccaggagcccaagttaccgcaccatactacaattcccatcgcttaccttctgcgttccaagatccaacagaattcatcgcagaacgctggacaagccgaccagatcttatcaaagacaagcgcgcatacgccccatggggtgctggtcaacatatctgccctgggaaagcgctcgccaacgtggaattacgttatgtgacggcgcttttcgtcaagacgttcaaaatcaagttcgcgccaggtcatgacccggagaagttttggacagatatgctggatcaagtaacaatgcagccgggagaagtatggtgtgtctttgaaccacgaaactga

SEQ ID NO: 431 - DNA, 981 bp, Botryotonia cinerea
atgagatccacagatcgtcctacgccccattcagcaattcagaacccctcatgggcaatggatttcatgcatccctttctgcaccgtataacgttgttgtacaagattgccaaatatttctggctgttcacggagagtgattttgccacttttgtaattccaaacaccgttttcggggtctgctctgcaattgcgggctatcctgtggtatcgacgtctacaacaagtggggcggtcttaagaagaattcctgccgtcatctttttcaattggtcaaatctccttgtttttgacttggctaatcagcgcctatgggaggccgttgaagaagataaactcaataagccatggaggccaattccgagcggcaaaataagtcgctccgaggtcaggcaggctatgcagatggtcatcccacttgtactcgcgctaaaccattattttctaaatgttggggctgaaacggcatgtatattgaccctcacctgggtatacaacgacttgaaagcgagcgatgatggatggatccaacggaactttattatcgctatatcttttggtgtgtacaattggagttcgctaaaagtcgcaattggggcgggagggctttcatcaacagcggagattaccagagtcggtctgtactggatcgctttgatgagtggtgtcatcctcaccacaatgcacatacaagatctgaaggataccgtcggagacaaggagcgtggtcgccacacatcaccgctagtccttggggaaaaagttgctcggtggacgctggtcattcctatcacttgctggggacccatttgcatgcattactggaaactttcttggatcatgaacgttccggtcacagcgctaggactttatgtggcatggagatgcatttcgtaccgtgggaacacggaggatcgaaagacatggcaattgtggtgcggatggaccgcactgctgtcgctcatgccactccagatctga

SEQ ID NO: 432 - DNA, 1380 bp, Botryotonia cinerea
atggcgaatcatattcttgaatcgaggggtgcaaagcgtgttggaaagctctggacgcatcgattcgtaaagcgtcgaatcgaattaaagacgcgttttagtcgtgtttatgactttcaaagggctctctgcgaagatcctaaacttattgagaagtggtttcgactagtttcgaatatgcgagcgaaatatggtattctcgactgcgatttctacaacttcgacgaaacgggctttatgatgggtataatatgccccggaatggtggtaactagtgctgaacgaaatggcagaagcaaggcaatacaaccaggcaatagagaatgggctacagcgatcatatgtggtaatggggagggtgaaactatacccccatttctagtggttcaaggacaggtccatctttccaattggtataccgaaaccgattttcctgcggattgggctattaagcctacatctaatggatggacaaataacgagacggggttagagtggttgaaacacttcgacaaacatactaagaatcgaagaaagggcaaatatcgaatgttggtgctagatgggcatgaaagccacgaatcaagagcttttcaagcatactgtgaagagaacgacatcatatgtttatgtttaccaccgcattcaagtcatctcactcaaccacttgatgtaggttgctttggtaatctgaaacgttcgtatagcggtcaaattgatgggtttatcaaggcgcatatcaatcacatctcgaaggttgagttctttatagcttttaaggctgcgtacgaagaatcaatcacctctcagaatatgaaatcagggtttcgaggaacagggttaataccatttagccctgaagctgtactttcgaagttagatattcgaattcgtacacctacccccccctctttcgatctagatcaatggatctctcaaacccctcgcaacccaactgaagctctttctcaatcaacattagttaaatctcgaataactcgccatcaatcaagctctcctacacctatatttgagactgtactagctctagctaagggtacagagagattagctcatgagaatacacttttaaatgcagagattcgtacacttcgggcagcaaatgaggcattaagcaaacgtcgacgcgcgaaaaaaactcagttacgtcaaggaggagtgcttactggacaagaggctcttgatatattatctcagcaagaggttgatattcagattcaacgcgacgagcgtcaaaataagggaaatcctattggggaagcatcttcgaaccggtgctgtagtaagtgtggaaaatccggtcataattcaagaacttgtcagaacaatgtaatagatcctagattactggattcttaa

SEQ ID NO: 433 - DNA, 1167 bp, Botryotonia cinerea
atgggaaacacaaactcgcatcccaagcacttgggtgccttaacgtcgccaaaaggtctagggaatgttgttaccatcgttatcttcgcaattctcagcatcgctgctgttggcttgcgaatctggagtaaagtcgtcatcagacgtgctttccgggcggatgactattgcatcttcgttgctctgtactccatttcgaaatcgtcgttttcgtcagctaatcaaactttagctgttgttccaggagctttaggctttcatgtcgaagaagcgttgaaatatttgggacccgattcacttactgttaccttgaaagccttccttgcttcatccccagtctggatcatctcgaccagtttggtgaaaatctcgattttatcgttttatacaactatcttcccttcccggacgtttcatatcatcgtctactcgattattgccgtgaacgctgtgtactgcgtgggctacatttttgcatctctgttcatctgcacaccatttgctttcaattgggataaaaccttaacgaatggaaaatgcggcaacacgcttcagctggagattagctctgcatccatcaacatgatctttgatctgatagttgtctttctccctatgccaacgttatggagactcaagatggctgtgagaaaaaagctatttgtcagctttatcctaggtcttgggttatgcatttgcgtcatgaatataactcgtgttgttctcgagacgcgtcaagacaatgtcgacttcacatacggattggtatacgcaggtcttttcgctggcttagaaaatggcatcggcattatcgtcgcatgcctaccaacctatggtcctttgatacgagggcgagcaaaaggattcaacagcgctgagccggaaagctacattctcaatcgcaaaaactcttactttcagaggaagacgaaagaatcctcttatacaactaccatggcctcattcgacgaagaaggctttgaaaggttgcatgaaaatatggatggcgttccactgaagagtctgcagaacggaggagtaggagcccaaagttctgcatgggtagccgttgactcccgcagtgataaatcaaccctgaacttcggtgaatctgaaggtatcgcggtaaagaccgagctcaaaatgacgagctcaggagtgccatga

SEQ ID NO: 434 - DNA, 423 bp, Botryotonia cinerea
atggctccactcactctcagcgctttccactggcgaaagaagggactcactccagaggaattcaagaaccactatgaaacggtccacatccctattctccaagaaatagctggcgataagttcccaaagacgcacacaagacattatgtggtccgaaccgctgaaggagccacatctgatgacaagtccaactcgaactacaaagcaagtgtttatgctggcacgaactccgaggatttcgactacgatgtgtatagtgagctcgtcttcgaggacgaggcaagtttcaaagcctttgaagctgttatgtttgatcctgtcttgggtccgaagatcaatgaggatagcgtcaagttcatagaccacgtaaagatggtttggatcaacatttctgagtccaccacggctcagacatccaaatag

SEQ ID NO: 435 - DNA, 1734 bp, Botryotonia cinerea
atgcggtcgtgcaagtcatttctaggccttgtggcgtttgctttgggagcttcagcacagtatagcaaccagaccgcgccgactaatgggagcctagcatcgacctgtctttgctttcctggcgatgcatgctggccatctactacacagtgggatgcgtttaacgcaacacttaagggaaaactcattgcaaccgtcccgctagccagcccttgtcacatcgacggctttgagacatatgatgttgataagtgtaatgctgttcgaaacaactggtggtacccagagactcattacaccacatcatcttctgtcatgacacctttctatgccaatagaagctgcgaccctttttacccagaagatttccaatgtgtatacggcacctatgttcgatacgccgtcaacgcaagctcagcgttggattatcaactagctctttcttttgctagtcttcacaatatccgcctggttattcgcaatactgcgcatgactaccacggaaaatcaactggagctggaggcttggcaatctggacgcacaacatcaaaactattgtaatttcggattatgacaatgagtcagtggactattgtggaaaagcaatcaagatcggtgctggcgttcaagcttctgagcttcttgaagctgctcacgaagcgggttatctggccgccgttggttacgctggatccattggaatcactggtgggtatgcacaaggaggtggaaccggtccgcttgcctctgtgatagggctgggatctgatcaagttctggaatgggaggttgtcactgcagcgggaaaaatcgttactgccacagaaacgaatgaatattcggatttatactgggctttgtccggaggtggaggtggaacctatggtgttgttctttccgcgacatataagctgtatgaggatatggagacaattgggggtaaccttacattctacaacacaggcacttctcaggacaacttttacggtgtcatcggaagctttttggaagctcttgatgcatatactgcggcagggggtggagttaactggctcaacactggctcatactttagtatggctcccgcaatagccgcaggaatgaatcaaacacagttcgactcattttttgccccgacgctctcgaaattgaaggagaacaatatgtcatatgtatatgcctccgagacgtatgatacttttgcggatgcttataacggccaagcgggacctgagaatatcaccaattacaatatcggaggccgactagtttcacgtgatgtggtaaaaagcaacgttaccggagtcctagatactatcaaatggatgaacgaccttggggttgtggtagcaggtttagcacttaatgtggaggctacggatgagacgcccgagaactccgtgaaccctgtgtggcgtgatacgcttttgtctatcaccactggactggcctgggatgacactgattggaacgcgaacttagctagtcaagacctaatcaccaaaactatagtcccgagattagaggcactgacccctggaggaggagtatatctcaatgaaggcgacccaaaccaaccagacttccagcaaaacttttatggccgcagttacggccgtctgttatcgatcaagaacaaatatgaccccaatcatgtgttttacggacctacagccgttggaagcgagtattggacagaagaagctgacggaagactttgcaaaagcaattag

SEQ ID NO: 436 - DNA, 501 bp, Botryotonia cinerea
atgatggtggatatcgaaggttacgaagaatgctggactaaaagcatctttcactgtctgttttgccacggctatgaatggtcccctgcacagtcagcttgcatacttgcaataggcgactgtgcatttccccatgtagctcttcacctagctcgtcaagcacttcgactggctgaaaacgtcacaatctatgtgcacggaaacagggccttagctaaagaaatagaagctgcaaaagtcgcgtcaaatctagatgtcaactctgagtgtcgcattcataagccagtgactgagcagaccaacaatcttgctcgtaaactcggaatcgaattaaccgagcaaggagatataaaggtcacgtcccattttaatgagacaactgtaagaggggcttttgcgactggagattgcgcgtcaatgttgaagaatgatgtaggtactatgtatggcgggacttgcgctggtgctggtgtcgggtcccagatccaaggagaagattag

SEQ ID NO: 437 - DNA, 1068 bp, Botryotonia cinerea
atggtaggagaattggagtgtgataatcttgttgctctcgtttccatatacatacaaaattacgccctctttggcaccggtaacatctttctgcagatcattcctcgcattcaaaagatcttcttcaaaccgtcaaatgatagtcgacgcgctctccagaacgcatcatcccactacgatacctcgaacgcaattttctcttcttttctatccccagatatgagttactcatgtgcgatatgggataccactggtaaagaagaaactctcgaggaagcacagagacgaaaagtgcacaacatcattgacaaagcggatatcaagccagaacatcatatcctcgacattggaggtggatgggcatatctagctattgaagctgtgaagaaaactggatgtaaagtcacagtgataactctgtctattgagcaaaagattctgggcgagaaaagggtagagaaggcgggattaaaagatcgaattgagatattgctttgcgattacaggcagactccaaagccaagccctgcagggtttgatagaataatcagtgtcgaaatggtggaacatgttggggaggagtacatggaaacctattttaggaagatcagcgaattgttgaaccaagaaaacggcatcatggtagtccaagggataaccagaaagaataaggacttccacaaaactcgatccaaggtcgacacttttattgatcgttacgtcttcccaggaggatatctccccaccgtaagagaaattattgaacgtcttgaagtaggatctactggttctctagagcttgaaagtgtgcagagtataggtcctcattatgtgcgaactctgcgattatggagggaaaattttatcaagaactgggatgagacgaagttgttgtacatgaaagaaagaggagatatgacgccgttggatctcgaagctttccgaaaaaggtggatcagttactttagttattgcgaagcaggcttccgagctggtgttctgggtaaccatgtaattactgcaaagaggccacaagcttcgtctccaagtggaattgtcccaatttga

SEQ ID NO: 438 - DNA, 684 bp, Botryotonia cinerea
atggcgtctgtaaacaaacctggacttccaaccttccaccacctcaataactcccaatcccaacgaatcctctggtttcttgaagaattaggaatcgaatataacctcgtatgccatacacgcgttgaaggtcgtgcaccgcccgagctcaagaatgttcatttcatgggaaaggctccggttcttgtcacatccgacaatgtgcccatcgcagagagcagtgcaatcctcggatacctgatcgacacgtacgataaagatggtagatttgtggctcagaataagattcgcgatgagagtttgtcgtccttcgctgggtcgactattggtactatctccatgatcgaattgatatttgatattgtcgcacagaaatctccgtggccagtatcaatattactcggtggcgttaaatcgaacgtgcataagagtttcaccgggccggaatatgcaactcaatttcaatatctggagaaggaactgacagatgtctggttcaatggcaagaatttgggaaggtctgatgtgatgctgagttggcctatggatttcttggctgcaaagaaatatgtggacttcgagaagtaccccaagattctccagtggaggaaggggatacaagagagagatgcttggaagagagcgatggaaaagggtaatgggtatgaattagcggagatataa

SEQ ID NO: 439 - DNA, 1065 bp, Botryotonia cinerea
atggctaccgttaagcaaaaaccgatagttctgcatattggcgacccagtcaaatggaaccttgatttatatgatcaattttccgaggactttactatcatacgaccttcaacagaagagcgtcaacgtgatgccttcatgaaaggcttgaaagtaaacagatggggcaacttttccgcaatattcagaccgttctggaatactggtggtgaaatggggagatgggactcggagctcattcccttgatacctgaatcatgtcgaatatttgcatctgccggagctggttttgattgggccgatgtagatcttttggccgaccgaggtattgtctattgcaacagcgccacggctactacagaatctgtagcagattttgccattttcttgatcttagctacatttagaaacctcacttggtgcactcaagctgctcgttccggtgcagcttcgttccaagattgtcacaccaatgccgcatctatgtcccacaatcctcgcggccatacgctcggtattgttggcttgggaaatattggctataacatcgctcgaaaagcttccctagcattcggaatgaaaattatgtactacgacatcgtccgaaagactccatctcaggaagctgccatcaaagcacaattctttactgatgtagatgatatgttagccctgagcgattgcgtggttcttgctacgcctgcctctccggacggaagaaaattccttgatagacagaggttgagcaagttcaaggaaaaaagtagattcgtgaacattgcgagaggtatcttagtggatgagcaagcattggccgaagctgtcgagtcagggaaattggtgggtgtaggactggacgttcatgagcatgagcctagagtaaacgacaggctaaaggcctctaggaatgttacacttaccagccataatgctggtgggacacttgaaacccacattgggtttgaggaattggcaatgaaaaacatcgacgcagtactaaaagggaaggagccattgacgcctgttaacacgcatttgattgggaaggtgaagcataatttgtga

SEQ ID NO: 440 - DNA, 1005 bp, Formitiporia mediterranea
atgttttcagaatcccatctcaagatgtctcgtaccttcacccagttctgtttcccttctgtctcgccatcctcattggtaattgaagtcgacttcttgtcgtctttcgctttgccagtgctacgtttcattgtcaaactcccttcatacgccttgtaccatctatggacgctatttttattcacgaagtcagacattaagacaactgtaatacctataacttctctggccgtcgcgtccgctccacttggcgatatctcacatcttccacatgttatattctggatttggtttcatgtcctacagttcgacgtctcaaaccagacgctgaaaccagaagaagacgagtacaacaagcgagaccgtcctctgcccgcaaagcgcatcacttggcgcaatgcattgattttgcgttgggttctcgtcccggcgtgttggatactctcatccttttacagtgttgaaactgtgtatgcgagtatcgcactgtgcattctgacatatgtatacgacgaaatgggttatgctgctggtcactggttcggtcgcaatttcgtgaatgccttaggcttcatgtcattcgaagttggagcttgtctcattgctggttcgaatcgacatgcgcttgatcatataagttggctatctgtactatgcagtgcagggatctttgcaacgacgatccaggcccaggacttcaaggacactgaaggtgatcgacttgtgggccggaaaaccttacccattgttgcgccgacagttgctcgtcctactcttctgctcgcgcttttggcgtggtctatcggattaagcacgctttggcagctcagcactactgtagcccttgctttcaatgtcctagccatagcagttggagcacgtttcgtttcacttaagtccatcaaggcagatcagcgcagtttttatctctacaacgtttggttatccgtcgcacacgcattaccagcgtatttccgttttatcgctcaggcaccagtgttctga

SEQ ID NO: 441 - DNA, 1608 bp, Formitiporia mediterranea
atggatcccgtactgcgatggatgacatctgaacagacgtttacccctgttatcggcctcgttggtctcttctgtagcctcggtcttggattatacgctagtaaacgagcctataccccaagcaaacaaagtctaggacatggtctcccgttgcctccaggaccaaaatcactccccatccttggcaatgctcttgatatgcccaacaagcgtgaatgggagacattcacaaaatgggcagacgaatacggtgatattgtccatatcaaggtgtttggacgtgatattatctacattagctctgccaaagttgcgagcgacctgtttgagaaaagatctgctatttattccgacaggccacgtttgcctttacttgcagagctgatggactttgagtggaacttcgggttcatgcattatggagacgaatggcgaaagaatagacgaatgtttgtgagcaagttcggtccgacgaaggttcatactttcaatccagtccaagaacgtgcttctggtcttctgctgggacgacttttggagacccccgaggacttcattgaccacctccgtcttcatgctggtcaattgataatgatgtccgtttacggtatatttgtcgactcaaggcagcacccgtatataacgaccgctcaagcagtgatggactccgtttccgatgcggcacgttctggtgcatatctcgttgatgcgttcccaatactgaaaagattaccaacatggctacctggcacacattaccaacgcattgcacgtagatgggcttccgatgtacgaaagctcaggtatattcctttccttgcgagcaagactaaattggaagatggtgcaccgccctatccaacctttgttgctgatatgctagaggagtacggttacgatgaaaataacgctgagaatatgatccgggactgtgcagctctcgcgtatggagcggggtcggacacgtctgtctccactttatcggcatttatcctcgcaatggttctttacccggacgttcaaaggagaggtcaagacgagttgaaggctgtcattggttcgtctagactccccacgttcgctgaccgaaaggatctaccatatatcatggcaattgcgaaggagacgattcgctggcacacagttgctccacaggctcttccacatgttctcagagaagatgatgtctacaatggttattatcttccagcggggtctattgttattggaaatacatggaaaattgcgcatgaccctacagtctatccagatccaatgaacttcaagccagaacgctacttcaattcagagggtgaactcgactacgcctccatagatccagcaaagtttgcatttggttacggcagaagaatctgtgcaggataccattacgctgagaacacgctgtggattacaatcgctttcattttgcaggttttcagtattacaaatgcaaaagacaaggccggtaatcctatccctgttactctaaacgcttcctcgggtgtcatatcccatcccgagccattcccgtgttcgattatgccacgctctacagaagcggagaccataattcgccgagccgctgccaatgccaattttgcataa

SEQ ID NO: 442 - DNA, 1581 bp, Formitiporia mediterranea
atggcaccaatcataggtgccgcaggaattgcttgcaccctatgtttgggtcttttcgtgtatcttagcaagcgagctcaagcacccagcaaacagagcagaggacatggtcttccgcttccgcctgggcctaagccactgccgtttcttgggaatgcacttgatatgcctgtgaaacgtgaatgggaggcatttgccaaatgggcgaatgaatatggtgatattgttcatgtcagcgtcttcggccagaactttattttcctcaattctgccaaagttgtgaacgacctgttcgacaagaggggttctatctattctgataaacctcgcttaccattactcacagaattactagactttgaatggaacttcggttttatgccctatggagaggagtggagaaagtatagacgcatgtttgtgggcaagttcggagctagcgctgctcatatcttcaatccaatccatgagcgtgtctcgggcctattgctacagcggtttttggatactccagaggacttcatagatcatcttcgcctccatgcgggtcagattatcatgatgtcgacatacggtatttttgtagattcaagacagcatccatatattcaaattgcccaagccgtgatggactcagtttctgatgctgcacgagctggggcatacctggtagacgcgtttccgatcctgaagaaagtaccaacgtggttccctggagcgcattatcagcgtgttgctcagggctgggctgcggaagttcgaaggcttaggttcattccttttcttgcgagcaagaaccaattggccgacggcaaagcgccaccttttccgtcctttgtcgctgatgagctagaggaaaacggctatgacgagaaagacgctgaactgatgattcaagattgtgcggctgtcgcatacggagcgggatccgacacttccgtcgcaacgctcactgcattcgttctcgcaatggttattcacccggaaattcaaaagaaagctcaggaagagcttgcagcagtcgttggaacttcgaggctccctacgttcgctgatcgcaatgatctcccatatatttcagccatcatgaaggagacaatacgatggcatacagtagctccgcaggcactcccgcataccctcagagaagatgacgtatataatggttatcatatcccagcaggatccattgttatcggcaatacttggaatattacgcatgacccggcactctacccagaccctatggagttcaagccggaacgttttattaattcagaaggcaaactcgatttttccggcgccacggacccgtcaaagttcgcttttggttatggcagaaggatttgcgccggatggcacttcgctgagaatacgatattcattacaatagcactcgttttgcactgtttcaacatcacgaatgcaaaggataaggctgggatgcccattcctgtctctcttaatgctggttctggtgtcatttcgcatcctgagccgttcccatgttccatcactccacgctctgcccaggcggaagccttaattcgtcaagctgccgcctccgcccaatttgtctag

SEQ ID NO: 443 - DNA, 1599 bp, Formitiporia mediterranea
atggcagcgtacactggtccattacgctctcgcgcgatgtccttccctacgaagccagtccttaaagatctttttcgtcgacgtgcttccgtgtctcttgattttctcgtcgttggaggcagtatcgcaggtctcgcctgtgcgtacaatctaaaacaagctgggcataatattgagacgttttgccttgcatgtgcgctatgtcctcgtgtattgattcaacaggtatctggaggcatccgagttccgccaaatatgacgaaacttcttatgcattggggattgggtgacagattgatcaagactggtgtgcggtgtccctacatagagttcctcgaaagcgataccggatcgttccttagttctctggtgtttcacgaagaagtgatgagagagcttcaagctgacatgtatggattgacagtgagtacaaaaatagctggcgatcatctcgacacggcactcatccgacgccccgatcaacagtattcggatctttattcaatgatatatgacatcacggttgcatcgggagttaatgtagagtacaacggcgaggtggtagatgtggacgtggacaagccaagtgttacattggcatcagggcggaagttacgtgcggacattattgtcggtgcagatggagcaacaagtatagtgcgcgagaaattggttggacgtaaagaaaaccatagaccagggccgttaaacggctatacatatactgtccctgtcagtaagatgatggaagaccccgaacttaggccactagcggagaacaagggagtgtggatagtttggatgggaaataatacctgcgtcttgacatttttggttgtaagtttatcaactttatcggagatgaagattgacatacacacatctctaaagcgaccagacgagtatgcgattcaactgattcatcccactaagaatgccaggcatgactggtataagctaacgaatatggcggcaattgtgggtaaatttgatgactatgagccaagagtgagacgtcttttgcggcttgcaacgcaaggtgtcgaaacacggcatatcatacaagaaccgctggaagattggtacagtgaaaatggccatgtggtagtccttggggatgcagcccatgtattgaaccctggaacgagccatggttcttcactggctgtggaagatgccgcagttctcggttctctcttctctcggttgcgtacacgtagctcacgcgaaattctgcgattgctggctgcgtaccaagaaattcgagaggaccgctgtatcgaagtcacgagaaccgagtacgaaacttgtgcattttcagttctgcccaggggggatcctagacgcgaagagcgagatcttggatttgctgcctcacgggatatgaaggttctcgattgggaaaatctcgacgacccgttcctacaacgcatttgggagcaattcaagggttctttcggctacgaggcgtacgatgccgcggatgattggtgggtagattggggtattatgcaagaacggatggctgcatcatcaatggctgttatcgagagctacgagtcctcgcagaacggcgaaggcacggatctatacaactaa

SEQ ID NO: 444 - DNA, 1176 bp, Formitiporia mediterranea
atgccttttcctacttctcctgtttatgaaaacctcttccaccggcgtgcagctgttacgctggatgtagtcatcgtgggtgggagtattgcaggcctgtctgcagcgtacaacctcaagcaagctggtcacaactatggcgatctgtatgagttgatccgtgacatcgcattgcgctccggtgtgaaaatcgactacaacacgactgtgattgatgtggataaagattgcacatttgtgcttcttgaggacgggtcaagaatcaatgcagacttgattgtcggtgcagatgggacctatagcctcctacgtgaaaagattaaggacccgcttcttcaaccgctaacagaagatggatcgtggacattatggatgggggatttacaatgtacccttggttatcttgctgcgccggatcattacctcgtgcaacatatcgatacgaaaaacacaggcacacatggatggaagcaaactgttccattatccgaacttgacttttctgcgtttgaagagagagtgcaacgacttctgtctctcagtactcatgcggccgagaaccagcatatcgtacaaacccccattgaaagttggtattctaataatggcagactagtccttgtcggaaactccgttcatctctcaagtgcagggtctatgaatgaagttgctttgtcggtggaggatggcgcggtcttgggcagcctgttctcgcgacttcagtcgagagatcaggaagaaattctccgtcttctcgccgcgtatcagaaaatccgtcaggatcgttgcaatgccatactacaaactgacaacgagctcttgacattctccacgctgcccccaggatctgctcgtgacgaacgtaacgcaggctttgccagggcatccgagcagaacatgcttgactgggagaatgtggacgaagacgttctgcgtagtgcgtgggaagagtttcggaattcattcgggtacgaggcttacgatgcggcggatgactggtgggttgactggggcatcgtggtacatcgcctatcagccgctcagaatgccagtaccatagacgatgatggcgatgcttctaatggagagtgctcgtcaccgttgcaagccggactccgcacgtctatcttagatggactgcataaacagactgttattactactgtggaaaattag

SEQ ID NO: 445 - DNA, 4236 bp, Formitiporia mediterranea
atgggtgacgctcgtctgcagcgtgttctgtcaagactgcggaatcttcctgcaatcgctttgccgaccgactacccaaggccctctggaacgagtaaagtcgtcgaagctgtccagacggttgagctctcggaacaggtatcgctatctctattgaaactcgcattgtatgaggaggatagcgagaaggacgacgatgatgatctggccttgaaaaatcgaccatcgcttttccagcttttactagcagcatttaccgtactgctgcatagatacaccggcgatactgatatcgttattgcctcgtcctcggcatctgcgagtgaccccttgctactcaggttatcagtagaccctacagatcctttctgggcgattgtaaggcgtgtgcagcaggtggaaaaagaggctgaggatgactccgtcccattctcaacgatagcagaggcgcttaagactgaagacaacaggcctttgtttcgagtccgattcttcgacgagacagattcgcctcacgatgagtttgtacgttcgacgagtttaatctctgatttgaccatctccgtcattcgcccagcaatttcttcgtctcacgcatcgctggctccgcgcatctctctaagaatattatacaactcgctactttttactccttctcggatagagtgcatcatagatcagctttctgtgctcttgcgcaagttgggttcatcacccattgccgccgtagggagtattccgcttcttactcctccacaacggtcgcgtcttcccgacccgacagcagacttgcactggtgcgactttaaaggcgcaataaccgacgtgttctctcgaaatgcacgcatgcatcctgaacgcccgtgtgtcgttcagtacacgccgactcgcgacaagatcgtgtacacctacgcgacgatccgccgtgcagctaacatccttgctcaccatctccttcagggtggcgtaaaacgagaggaagtggtcatggtatacgcgcatcgcagtgttgaccttgttgtagcagttatggccgttcttaaagccggtgcgacattctccgtgattgaccctgcgtatccaccttctcgacaaacaatctacctggaggtggccaaaccaagagcattggttgtactcaagggtgcagggatcattaatccatctgtccgtaaattcatctcggaggaagcaaatattcgtgtcgaagttcctgctttggagctccttccagatggttctatagccggaggcgaagcgccgggttccacggaggatgtcttgaaagcacacatacaccttgctgacacagacccaaatgtcgttattggccccgatagtattggaacattatcttttacaacaggcagcaccggcattccaaagggtgttcgcggaagacactacagccttacgcattttttcccttggatgggcgaacgttttgaattggatgagaaatctcgctttacaatgctaagtgggattgcccacgatcctattcaacgagacatgtttacgcctttattcctcggtgcatcccttcacgtacctacggctgaggatattggaacaccaggacgcctcgcagagtggatggcggacagtcaagtgactgtaacgcatctcacacctgctatggcattttttgttggtgatgtactcacgaagcgcgactgtcaccgcctgcagggtctcgcaccgcacgtgcgtatcatcaatatgtacggtacaacggagacgcaacgagctgtgtcgtatttcctcatcccaagcgtctcagaagacccaaccttcctcgcaacacagaaagacattatgcccgctggagaaggcatggtcgacgttcaattactcgttgttaatcgcaatgaccgtagcatcccgtgcgcgataggtgaagttggtgagatctacgtccgttcaggtggtctggcggagggttattccgatccggaggcgacggcacaaaagtttgttacgaactggttcgcttctggaacttggccggacacgattttacatccacccaaaggccttgcaggaccggaatcacgctactggaagggtgtacgcgaccgtatgtatcgatctggtgacttgggccggtatctacctgacggcattgtcgaatgcactggtagagcagatgatcaagtcaaaattcgcggtttccgcattgaattgggcgaaattgatactcatttaagtcagcatcctctcatacgcgaaaacgtcacgcttgtcaggcgcgacaagaatgaggagaagacgctcgttagctacttcgtaccgctggaaggtactgcacttgatgaatacgccagcgatgtgccagatgcggagggagaccgtgctttgttctctggtataaggcgttatcgtcgactcataaaagacattagggaacacctgaagaggaagctcccgagttatagcgtgcctacagtctttgtacccttgaagcgcatgcctctgaacccgaacggcaaaattgataaaccggcgcttcccttcccggatactgctgaagctgccacgtctgacatacgccccaatgttgaacaagccggcgcgttgactgcgacagaaaggcatatccagactatctggggcaccattctcactacaatgcagcagccaattgcactggatgaaagcttctttgacctcggtggacactccatactcgcaacgaggctcatctttgagcttagaaaggctttcgtcgtcgacgctcctctaagtcttgtttttgaccatccgacaatcagagagcaagcttccgagctcgatgctttgcgcaactccgatttaggtttggcttaccaggacaagggaagcacgacagctcttacgaggcaggatgggaacctgctgaatgttcctggtattcccaagaaacgcgcgcaggtagttgaatacgcgaaggacctcgagaccctgattccacgcctcagggggaagtatgacgcgctatccccatcgtcgtcaatgttgacggttttcttaactggcgcaaccggctttctcggagcattcattctgcgcgacttactgtcacatcagtgtgtgcagaaggtaatctgtcatgttcgcgcaacatcacgagagaaaggattggagcggctcaaagagggcgcgggtgatcgcggtgtatgggatgagagatggttagagacaaagcgtttggaagtcgttaacggcgaccttgcaagtgagaggtttggtttggacgatgcaacatgggaacgcatttcgaacgaagtggacgtcgtcgtgcataacggcgctttggttcactgggtctacccatatgagaagcttcgctccgcaaatgtgctctccaccttaacagctatcgacctcgcttccacaggacaaaagtcgaaggcccttgtgtttgtgtcatccacggcagtgcttgaatgctcgcattacgtccaactttctgaccaatcgtcgcgtactggtggtggcgggggtgtgccagagagcgacaacctcgatgggtcacaaacaggtttgaagagcgggtatggacagacaaagtgggtgtctgagaagctcttgaatgaagcaggaaggaggggtctcagagggtctattgtgcgtcccggatatgttgtcggagattcacagtctgctgttaccaatacggacgattttatttggagactggttaaaggctgcatccagcttgggctcgtgccagatataaacaacgccatcaacatggtcccagtagaccatgttgcgtacatcatatccgcagctgctgtgtccccttctacggtcgaaaagcacggcattccggttttacatgtcactgcccgccctccgccaacgtacaatacgcttttctcatctcttcgccggtatggctatgccgtctctcaatgcgaatacctggtctggaggcgacgacttgagcaacacgtccttgcatcacaggacaacgctttattcccgcttctgcatttcgtacttgacgacctaccaacgagcacgaaggcaccggagctaagcgatgaaaatacacgtgcattattgaagagtagaggagcaaaagagaatgttacagtggatggtggattaatgggcatgtaccttgcctggttggtagagtcgggattcttgcccgtgccatccgcggacgattcagatgagaagctgccgagcatacgcctgcaggaaggcacacgtgtgcgtgcagttgggaggagtggtgcataa

SEQ ID NO: 446 - DNA, 2025 bp, Formitiporia mediterranea
atggcaaattttgtgcgccgaattgtgtcaggaaacaaggctcgcttcaaagataaacaattggatatggaactcgacctaatctatctaactgaccacatcattgtaatgggattcccagccaccggcgtggagggcttgtatagaaaccgcagagaagataccaagaagttcctcgaccatcgacatggaaagaactattgggtattcaacttctgtccactccgggagaactcctatcctgctagcttctttgaaggccgagtaagtcgttatcctttccctgaccaccacgcgcctcctttggccattttcccccttttcgttcgtgaagctcgggaatggctctccgcatcgaaggataatgttgccgttttgcattgcaaggctggaaaggggaggtcaggcacactcgcatgcgcgtatcttctctccctcgatgaaacaccctcgcctccaaagctccagcgtagcatgaccaagaaagaatgggcaaagaatcgggctgaacgagtaatggagacggttgaaatcgatgagatggacgaagtgctcgtacaggaggatacgagcgtcccctcgggaagggatgcgtccaaacccatgtctgaatatgtcggtgaaatcacactgccttcaaccttagaaccagaggccgaaaatccagagccgaggaataaaggcaatggcggtgatggtaacgctgcagccacgatcatcggaaaaccgaaaaccgagacacccacaagtctaagtcctcgtggtggatctatcgcagacaatattgaccacgatggtatgcaagatgtgaaagacaggtcgaaggctagaccctttacacttgaggatgtacttgctctccacacagcaaggcgtatgaagtcaccttcctcgccggataagaaagtcaaacatggcgtttccatcccaagtcagagacgttggttgaattactggtcgttacttcttgcaaacgaggcaccgtcagccttctggcagtcacctcttccacgagtgcgcttacgtgaaatacacgtacaaattcgcgacttgggcggactgaaaatgaaccttctcaaaattgcgaaccacataattgagaagacaggttctgcaaagtacggcgttcacgaacatggtcaaggccctatatgggtttcactcgcgcggtacaatgacgaacttgttgaacttttagagaggtgggagcatcatacgagggccgaggatgggaatatgggtaaaagacggcttggaacggagtacatggccggaactgcattgcgcgagatttttacagacggcaaatgggacaagagtaaaatgatcagaagttttgcacgcctcggtgcttctgacagtaagcggccagagggcgggaatgtggtgagctataagttacaaccgcttgcagaccagacgtgggaagccctccaagaggaaatgcaagagtctgacagaggtccagatcttgaccccgaaatgcgtcaatccctctcagcggcagagtcaagagcgaaagaaataacaatgtcagccaaaagctccgtcaccgactttgcgcatataatagacgatacaaatacggaaaagggagtgatattggatgccgctcgggaggttcgcgctaaactctacatgggccaagtcttcatggggtggttttggttcatcccagccttccacatgcctccacctcctgtagactcgaagcaacgatccttgccgcctaccgtgacaaacttcgtactttcgcgtaaagagattgatttccctatcggtgcgggtgccgcactggtcgacatcgatgtcgctctagaatgggttataccggacctggatccggtagccgctagtcgtggtccgccgaagacacagactagcggagattctgccaaaggtacaggcggggaacccggcggtcctggtggtatcgctggtagtgttgttgctggtgtacgagctgttgtctcagattctaccggaagggaagtggttgaggcactcgaggcgggtgaacagtaa

SEQ ID NO: 447 - DNA, 189 bp, Formitiporia mediterranea
atgtcatgtttatgggccgtaaaagggtctcctagtggtgaagtagatcggaaaccggccctggacttgcctcgcatcatgactgagggctgggactcgattgatattgggacactgaggagcatgcgtgcacggcatgacttccctattgcccttgcatttgcggcatcttcgccaaaccttcgttaa

SEQ ID NO: 448 - DNA, 837 bp, Heterobasidion annosum
atgctctctcagccaaccactttcatagttgaggccttgtatacggcctttctcttcacaaaatccgatataaagacgacagtcataccaataacatccttcgcggctgcagctgcaccgctgtgtgggttggctcgtctccctcaatccgttttttggatctggctgcacctccttcagtttgatgtatcgaaccaaacgcttagcccggaggaggacgaggtcaacaaacaggatcgccctctaccgtccaagcgcatcacgcttcgaaatgctattttccttagatgggtcttgattcctgcatgctgggctttgtcagcgttctacagccgcgaggttctttgggcgagcatgtcactagtgctgtttacagtcatatacaatgagtgttcagcccacgccggacactggctcgtccgaaacgtagtgaatgccgctgggtttgcttcgtttgaggcgggagccactctcattgctggtcctaattctcatacactcgacacgactgctatcattgctatctgttgtagtgcgggtatatttgccacaactatccatagccaagatttcaaggatagggacggcgacaaggccataggtcgccatacgattcccattgtcgccccagccatcgcgcggtacacagtcgttataccacttttattgtggtctgcattcctctcgaatttgtggcaactcgatgtcgtagccagctgtggattcttgatcgtggcgttattcgttggtgtccggtttttaatattcactaccattgccgctgatcaagtatcattctattggtacaacgtaagttatgagagtcgtgttttatga

SEQ ID NO: 449 - DNA, 1527 bp, Heterobasidion annosum
atgaatcatacgaccctcgctgcgctgacctccgctgccgtatctctgtcttactggcttttctttcgtcgccgtcaagtaccaggccctgcttcgcctcttccactccctccgggtcccagccctttgcctttccttggaaatgtcttggacatgccacggaaacgagaatgggagactttctctcgctggcacaaagcctatggggatattgtcttcgttagtcttgtgggccggcctatgatcatcttgaactcttttgaagctaccacagaactccttgatgatcgatctactacgtactctgatcgtccacgttttcctctgatcgacttgatcgatcacgaattcaattttggatttatggcttttggacagcaatggaagacgaatcggcgtctcttttccaaccagtataataagaatacagttcacacattcgagcacgcctttcgtgcttctgtttcgactctactcagaaacctgctacgcgaccctgagagcttcgcggatcacctgagactacacgcaggacaagtgatccttgatgtaacctacggcgtgacggttacctctcgcgaagatcctttgatccgaattgccgaagccgtcatggacgctacctcggtcgcaatcagtcctgccatgtgggttctcaatccaatccctatattgcaatctcttccaacatggctcggaggagagaatttgtctcgtcggctccggcaatggcagaaagacatacgcgatctccaggatgtaccgttcgagagggtcaaggcttctttggttacaagagacgtcaggccatctttcacgtcaatcttgttgcaggaagacgacagtgcagaacaagagaatatgatacgccaatgtgctgctgtggcatatggagctgcttccgatacaactgtcgcggccgcagtagtattttttcttacaatggccctttatccggacgtgcaaaagaaagcacaagccgaaatcgatcgcgtcgttgggtcagatcgtctaccgaactacaccgaccagggcgagcttccttatgttaccgcggtgttaaaagaagtactacgatggcatccgccttctcctacaggccttccacatatgactacgaaggacgacgagtacatagggtaccggattccggctggaagcatcgtcgtgggaaatatctgggggatgttacacgacccaaggatgtatcccgacccgtccgtgtttgaccctgaacgataccttcacgctggtcgacttgactgcagcaccaatgatccttcacgaattgcgttcggattcggcaggcggtcgtgtccagggaagaactttgctgaaacatcgctttggctcttggttgctcaatgcttggccgtgtactcgatttctccggctgatgagaaagcggctcataacctggactttacgtccggtgctatttcgcaccctatcccgtttccttgtatcataaggccgaggtcagaaagcgcgagaatgttgctggagaacatcagtgccgacttatga

SEQ ID NO: 450 - DNA, 1536 bp, Heterobasidion annosum
atgtctttcgtggtagccaacgtggcttctgctagtctatgtctcatctgcgtatacatcttgacttggcgatttcggcgactacgtctgtctctacctccaggtccgagacctttgccatttattggaaatctgcttgatttaccgcgcaagcatgaatggaagacgttcactcgctgggggggaatttatggcgatgttgtctatctcacgatatttggaacgtctatgcttgtcgtcagctccgttgaaccagcagtagatctcatggacaaacgatcggccatatactcagatcggcctcgtttcccgctcgttgatctaatcggacaagattggaatctcgggttcatgaactatggaaaaccatggcagaagcaaaagcaggccatgatgtccaagttcagcaagactgcgataactgcttaccggccggcgcaacatcgagctcttcgtatcctcctaaaaaacctgttggataatccagataattttacggaacacttacgactctattctggtcagctcataattgatgtaacatatgggatcccaatttcgtctcgagaccacgaactgatcaagacagctgaggcagttatgcacagcatcagtgtcgcactgtccccagtcttttcggtgttcaatcttactcatcttttgcaagttctaccccactggttaggcggtggacggttttcgaaccttgtacagaagtggcagtctgatgctcgagcgcttcatgagattcccttcgatatggtcaaggcgtctatggattctggaactgcaagaccctcgtatgcatcgtcgcttcttgagaatttgaagccacaggatagctcggatgaggagagtgtggttcgtgatacttcggcggtcgcttacggagcgggggctgacacttctcttgccgcggtgtccgttttcttcctggtgatgcttcagaatcccagggtgcagaagatggcgcaagatgagctcgaccgcatcatagggtcgtcccgacttcccgatcacggggaccagcctgagcttccgtacatcactgcagttatgaaagagactctgcgatggcacgctgcaacaccactaggtatagcacatatgctgacaacggatgacgagtacagaggatggcatctgcctgctggttctctgattgtcccaaatgtatggggaatgctgcgggatccgaagacatacgacagccctgccgagtttcgaccagaacgtttcctccggaatggcaagctcgattgtccagttgacaaagatcctgcgaggattctcttcggatttggcaggcgcgtctgtgtgggcaggcacttcgtgcaagatgcgatgttcctcctcatcgcccaggttctctctgttttcacgatctcgacaatcgacggcggttctccctcgaaggtggatatgacttcgggtggtgtttcgatgccgatgctttacaagtgtttgattcgaccacgttctgagatcgcgaagagggtactcgaggatgatatcctgagcgcagacgatgtctga

SEQ ID NO: 451 - DNA, 1311 bp, Heterobasidion annosum
atgctcgttattgcaagtcctgcgaaaccttttactttcacggctaagcgaacaatgcggcgaaacgtgatccttgacgactacgcggacgagattgcggcggcgtatcgctctatgaagaacgctgacaattcttccattcacgtaaaccctccaagctcttgggatttccctcggaccctcccgttcatccggtccgtcatagcctcaatattgaatggagggacatctgttggagacgatgatgacttatttcagcatggccttgatagtctccaggcaatggtgatcaccaatgagattctacgagcgttcagaaatacagctaccaacacgacgcgccttcaagataactttgtccatgcgcatcctactatatccgctcttgcacggtttgtgacgtcctgctctgggttaggacctgtggatacttcttccgacctgatggagaagaaagcagaagagttacaggagactgtagccaagctcactgcttcattctcggcacatagtcctcgtattggagcacagaagccaacaggcgaaacggtcttggtgactgggactacaggtagccttggcactcaactgcttgctcagctaatcaggatacctactgttacccgcgtatatgcgctcaatcgaggagaaccggaggagacgaggcgtagacaggaaaacgcatttgagcgacaggcgatctctagcagtgtggcccgttcgaccaaggtcgtttatctccgaggcgatataacatcgtccgctcttggtctaggtctagaaatgcgagatgaagtcctggattcgctgacaacgatcgttcataatgcatggatggtcaactttaacatgccatttgccgcgtacttgcccctcatagagggtgtgcgcgaggtggttgagctcgcattggcttcgcccttggctgaaccaccacgcattgtattcgttagctctgtgtccgctgttcgagtcgggaatggctacggagagtcaaagtgggccgcggagcgtatcatgtctgacgtgcggaggacgacagttctgaagacggtgattgctcgcgtagggcaactctgcggaacaaccacaaatggatgttggaatgcaaacgagtggtttcctttgattgtgcgctccgctgatgcattgcatagtcttccggagagagatgagttagtctcgtggcttccagtggacacggccgcatctgctatcctcgacctgcggcatgtaccggacgacatggacactcgatgtgccccttttgccatattccgagtggctgcaatcgttgcagaatacatctag

SEQ ID NO: 452 - DNA, 1311 bp, Heterobasidion annosum
atgactaccttggatgaagccccgtccgctgccttcgaagaacaaatagtcaaggccaatgctgaaccgaacaaagcccgcgatgttgagaagactgggtgggaggaaagtgcacaggaaattgactcggctcaggtcccggtcgacattcccgatggagggtggtgggcgtggtcgaccttggctggagcttcgctggagggtgagccatatgtgaacgcatatggagtctaccaagacttcttcgttcgaagttttctcagtaattactcgtcgtcctccatcagctggattggcagtattgccaccttctttttgctcgctggtggtgcagtgtccggccgattatttgatagaggatatttctattttctacttgtcggcggctctgtcttgatcgtcctatgcttgttcatgctctcgcttgccgaaccgcagcactattatcagatcttcctcactctcgggctcggcttaggacttggcactggtgcaacatacgtcccatccctcactatcatcgcgcaccatttctcgcgaagacgtgcgctcgccatgggaatcgctgcttcgggagcctcacttggcgccttgctccatccgatcatgctcaataacctctttcatgggccagtcggctttgcaaacggcgtgcgcgcgagcgcgggattgatggcaggggcattgatcctagcggggcttctcatgcgcacgcggctgcctccacgaaagggagctcagatgggtctatttatgtccgcgcgaaccttcgtgaaagacgaggtgtatacaatcgctgttgtggcaacattccttttcgtccaaggcgtcttcttccctctcttctacattcaactctactccgatgagcacggaatcaactctgtgtttgggttctattcgctcacgattctcaacttcgcgtcgttcgtgggacgcatcgtgggaggcgccttggttaaccgcttaggagccttcaacgttatcgtcgcctgcacgtttgcgagcagtgtgcttctgttctccttgcttggagtgtccacaatcgcgggcatcacggtgttttctttgttgtacggcttcaccagcggcgcatatatcacactggtggctcctatggtggcctcattgtctgcagatgtctcggagatgggtgcacgcatcggggtcatgtacttcttcacaggtctcggaagtctcataggcactcctatcaccggcgcgctactcaccagggattttgtctggtggcggccgatcgtatatacaggggcaagtgctgattggcgttctcgatggattgcgtgctga

SEQ ID NO: 453 - DNA, 1524 bp, Heterobasidion annosum
atgtcctctactgctgttcagaaaggcggcgtcttatgggaggcgaagaacgatacagcatccgactctcattatacctacaagaattctggctcccccgcgcgcacctgggattgtgcggtgcttgccaaggtagatttggtggtcattcctatcgtgggcatgttctattttttgtccttcctggataaagcaaacatcggcaatgctcgtatcgccgggcttcagagagacttgaagatgacgaatcatcaattctctacggctctgactgttacatacgttccatacatactcatggaaattccaatgaatcttctcatgaaacgaatcggcgccaacataactctccccaccatggtcatcttgtggggaatcgtctgcgcatgccaaggtgcagtgaagacatacggaggacttatcgcatgtcgtttcttcttgggagcgatggaaggcggaatatttccagggatcgtactctatctctcgtctttctacaagcggcatgtattgcaaactcgattttcgctcatgttcagtgtaacatcgcttgcgggtgccttctctggactccttgccgccgctattcagaatatggacggaataaagggactcgcgggttgggcatggatcttcattttggagggtgcgtgtacgactgcgttcggcctgattagcatgttcttcatacctgcgactccggctgacatgccatggctcacgagtgacgaaaaaacaatatatctacgtgagttggctgaggattggagtggggacgatgagaccgacatcttcagctggagtgaggtctggagcgttttcgtggacggaccgcatatattgttgttgtgccttcccatgtttctgaatggtgtcatgctctttggtcttgccaactttattccaacgattgttaatgccctcggcttctctccgacgcacagtcaacttttggcagcccctccttacgcgtgctctttcgtactcagcgtcatgtgctcctatttcgctgatagatacaggcaacgaggacctatgtgtatttgtgtgaacctcatcgcggctgcaggttatgcaatcttccttggcacctcgaacaagcacgcaaactatgcggctctgttcctccagatagtgggcgtatattcgactgcgccctgcattggaacatggagctctaacaacgtccaaccgcactaccgtcgtgcgactgccatcggattgaacttcatttgcacgaacattggaggtacacgctttcctctttgcgccatcaccttcccacagctatccactactgacgtgcaaacccctaggtatagtctctacatggatcttcactcaccccccgcggtttcacgatgcgtccgtcatcagcttaaccgcctcgctcggcacggtgtttttctccggaatcctgatggcctacctcaagtggcgcaacggagtgaagctcgaacaggtagagcggttgacgagagagaatggggaaggtctggaacctggaggatggaattcacatag

SEQ ID NO: 454 - DNA, 876 bp, Gelatoporia subvermispora
atggccgtttcggcggtagcacaccatattatacactggtcgtataccctcttcctcttcactaaatccgacatcaagacaaccgtgataccgataaccttacttgctgcggctgctgccccagcgccgtcgacaatgactctcttacattccaccttttggatttggctgcacgttcttcaattcgacgtctcaaatcagactctaaaacccgaagaagatgaatacaacaaacaagataggccactcccgtcaaagcgtttaacactcgaagcagcatatgtgatgcgatggatgctggtgccactctgttggctgtggtcggcgatgtatagcgtcaggacattttactcgagtgttgcgctggtcgcattcactgtcctttacaatgaatgtgctactcatgccggacattggcttttacgcaactgtgtgaatgcggcaggttttgccgcatttgaggctggttccacactcgtagcaaccattgatcatcgaactttggacaggactgcagttctctccatctgtatcagtgctggcatttttgccacgacaattcagacacaagacttcaaagatgtgcacggagaccgcattgtaggaaggcgcacccttccgatagtctggccatccgtagcgcgttacacagtcctcgttggactctgtctgtggtcactgattcttgcgtccatctgggacctgagtatcgatgcgcagatagtttctcatggtttatccatatttgtgtcataccgcttcatgacatacaaaggcatccacgaggaccagatatccttctactggtacaatgtctggctctcaatcgcacatgctcagccggcatactatcgttacttgagctctcatttctga

SEQ ID NO: 455 - DNA, 1533 bp, Gelatoporia subvermispora
atggttgatttgttgtttttccaacccattcaactagtcccgtggtgcttcttttgtattgcctacctcgtctggcgtcgatatggattcacccgagcgacaggaggtcgtccattgccccctggacccccgggtagacccatagttggcaaaatattcgatttcacacaacacgatgtgcaccgtttgttcatgcgctacagcgagcagtatggtgcattgcacgatctacatggcctgggaaaacggatcatagttcttaatgaactctctgcaatcaatgacctccttgagaaccgggctgctatatattcgcatcggccagaatcagtttccggaggcgttctcatgggcttcagcaagagcatgatccttttgccgtacggaccagaatggagagcgcacaggaagctcgctcggatggcccttggtccaacacagctgaaggaatatgccattctccaagaggatattgcagcatccttagcggaggctttactcgacacgcctcatgacttcttctctctcgttcgaatcggcgccggtaggatggtcatcgctgtcacatacggcattcgcaactctgcatttcaaacagagtgtatcatgaacggggagcgtttcgttgaatttgccaggaggacgtttactcctggaaattacctatgtgacattctgccattcctcaaacatgcaccttcctgggttccctttcaatgcgagctacaacacggaaaggaagcattcattgaattccaaaccaaaccgtttgagtatgtcaagcaagagatggacaagggaaatatcttgccatcgttgacccttcgtcttctgcaatgtcccccccaagggatgcccgatttcgagagacatctaatgtgggtcggaggagctatgttcggaggtatgcctgtctgcacctatgcaaccgttctcacgtttattatggcgatggcccttaaccgcgataaacaacggattgctcaagctgaaatcgacgccgtgatcggtggagatcggcttccaagaatcgaagaccgacgacagcttccgtatgtggatgcggtcataaaagagaccatgagatggcaacctgctcttccgttggcaggtctctctcggtgcacagcgcatgatgacttctatcggggtttcttcattccaaacaattctatcattgtcccgaatgtctgggcaatagcctacgatccaagatcaaagtataatccggaagcgttcataccggaacggttcatggatgtgaacgagaaaatcgttgatccggatcaatgggcgtttggatttgggcgaagagcatgccccgggcagaatttgggagaaaattccgtgttcattctagtagcgacaattttgtcggtcttcgatattttacctcccgagaatgaggctttggaacaagagtttacacagcacgtgtttcgttcccctaagccattcaagtgctctatttcgcctcgcactttcgccaaggcacgacttgtgcgacttcgagctgcagaaggcgtagcatag

SEQ ID NO: 456 - DNA, 1611 bp, Gelatoporia subvermispora
atgggtgctgtacttccacccgtttggacgggcacactcccgggtaacgtggatgtattgtgggaccgctggaaaacgttttcctgtggatatccatccgatagccacgccaagatgtcagagaaattaggacctacttttgcgattgattcgatgtggaggcatcacatcagcacgtcagatgcaaatgtcataaaggtgaacactgctagtcagattgtgacagacttctccaaattctccaagggcgatttgttccgcgacattatgcgtggattcctggggaatggtattttcaactctgacggagagatgtggcgatttcatcggcacatagcccgcccttttttttcaagagtgaaggctgcaaagcttgaccttttccaggcctatagcggtaacatcatttatcatcacatgaaagtacatgggtcgagttcagatgcagattctgccattgcaaaaatgaaagggcgcttcagagaagggcacaccgtgaactttcaagaccttgcctcgcgctatgcgctggactcgtctactcagtttttgttcggcaggagcattggttttttacgtgacccgctcccttatgaatggaacgccaagcgcgcagactcttctccgccgaatactccagcagagcgctttgctcactcgctacggtcactacaagaagtcgttgcagagcgttggcggttgcaaaggatctggcccctcttcgagatactcgaagacaagtgcaagacacatatgaaagtgctcaatttgtttgttaatccaatagtgcgcgaagcgctagagaggcactctaagttagaacatgactcaaacgagcggggcgcccgttcaccagagccagagacatttgtcgattttatggcgcatcacacaactgactcggtgcttattcacgacgaaacactaaacatgctgcttgcggcgcgagactcgacctcggctacaattacatttactgtgtacttcctttgcatgtatcctcatgtgctcaaccggctccgtgcggaagtacgagctacggttggtttgacacgttgccctacggaagacgacatacgaaacatgaggtatctgagagcagtgatcgacgagacgatgaggctataccctccagtatcttccaatgttaggaacgcgacatgtgacacaacgatacccaattctgacccgcgcggaaagccattctttgtacctgccgggacgtcaatagtctattcgcccttgattgtgggacgcagacaagaatactggggacacgatgcggaagagtttgatcccgacagattccttgacgggcggagggacaagtatctgcgcagaaatccatggatattcgttcctttcaatgcaggaccgaggacatgccttggacaacagtttgcgtacaacgcaatgtctgtcttcctgatacgtctgctccagaacttctcagagatgcatcttgcaccggaagcacaacctccggggaccctccctccggacgactggtcgacggcaaacggacgaaaagggaaggaacggtttttcccaaagaaaagcattacattatattcatcgggagggctttgggtgcgcatggatgaagggtag

SEQ ID NO: 457 - DNA, 1809 bp, Gelatoporia subvermispora
atggttgacaatatcacggacgtcgccagcaaagagtttgactacatcatcgttgggggagggacgtgtggtcttgtcttagccaatcgactatcggaggacagctctgtccgtgtcttggtccttgaggctgggaatgctaatttaaacgatgccatgatcctgactcctgctatgcgcgcaagactcttcaatgacccgaagtacgactgggccttccgcacagtcccgcaagagcactctaacaatcgagtgtatgcttgggctcggggcaaatgcctaggaggaagctcggcgatcaacttccaattgtggaacaagccggccagagattatcttgacgcgctgaccgagctcggaaatcctgggtggaattgggagacattcgacaaatactcaaggaaggcagagaggttcgccgtacctactcacgattcagacgttctgacgtacgacttggcccatcgcggcaacgacggtccgctcgtaacgtctttctcgagcgtcatttccggcctggagaggcccgcgttggaggcgttcaagcagcacggcgtgccggctctcgccgattcttcatcgggcttgacgaacggcttcacagcaatctccgcgacacttgatcccgaaacccatacgcgaagctactctgcgaacatgtattataagccagttgcctcacgggagaatctgattgtgctcgtgaatgctcaagtttcacggcttcaggtcaaaacgaacgacgatggtaccattacggctaccggcgttcagttcatgcacgatggaaacctatcggaggcaagggcaaagaaggaagtcgtgctatgcgcaggggccatcatgtcgccgcagatcctcgagctctcgggaatcggtgaccaggaggtactacgcaaggccggggtagatgttcagctcaatcttcccggagtcgggaccaatgtccaggaacacctctacaccggtgtgacctatcaggtcactggttccgaatacggcggacacgagctccagacaacggactcactgatgtatcccgaggaagctgcaaagcagctcgctcttcacccgtctggccaaggcgcatacaacatgctgcacactggaattgtcttccttccgctcgatacagtttgtactagtgctgccgacatacagaaagtgctcgcagataccatccgagccggcttcgagaaagacgcgtatccaaatggtcttcggaagcagtacgaattacagctgaggcatctcagggacaaggtgccgagcctcgagatcgtcatcactccgggacccattacccgccccacggttcttgacccaacgaggaagcaaatgtccctcgtcttcgcactcaatacccctttctcgcggggaaccattcatatcaattcgaatgatttccgggaacaaccagtgattgacccacgaatcttcgaagagccctatgacttgaacactttagtggagctcgtcaagttcaaccgacgcgtcgcccgcaccgagccactcgcaggacttctgtccggaaccgaagtttacccaggccctcagatagaaacggatgagcagattgctgagtggttgaagaacacaattagcacgacgtaccataccgtcggatcctgttcaatgttacccctcgaagatggtggcgtcgtcgacccgaagctgaaggtatacggcacgacaaacgtccgcgttgtcgatatctcgatcattccgctgcacgtgggaagccacacacaggcggtggcatatggcatagctgagcaagctgccgatatcatcaaggctgatatgtga

SEQ ID NO: 458 - DNA, 2091 bp, Gelatoporia subvermispora
atgccggtccgtcactcggcagcagccgcatcgaccgacttgggcgtccgcgttccgcgcgtggtcccatgcaggccattgctcgacttctcgcccaaaaatccagtctccatctgccgccatcgtttcgcactgacccgatcaacaaaacattcccatatccgccgtgcgtggtcttgtttgtgctcaccccctcgtctctcaatcaccaacatgggtgcagtagcgtctagccagctgaaagattctccgagcgtatacgcaactaagatccccgagacgggccaagattcgactgcgacgaagtcgtcgatcgacgtcaacggctggaatcagtatgattatgtcatagtcggcggtgggactgcggggtgcgtcatagcatcccgcctttccgaggaccccaacgtacgcgtcttgatactcgaggcagggaggggtcacaattcgggcttgttggacctcacccaccttcccattggatttctgcagctgtataggaccgaggtagactggaattttgagaccattcctcaggcccacgcggacaatcgacaagtgtacttcccgcgaggcaagctcttgggcgggtgcagtggcaccaatgctgccatattccatcactgcgcgccggaagactttgacgaatgggaacgcaagggagcagcaggatggaattatgcgaccatgatacggtacctactcaaagtggaaaaatatcttcctaactcagcctatcgcgatgtcgatgcgagccatagaggatcagagggacgcatttttactaagaagtctgaggagattccaccagtgaacaagaccgtcctggaggcatgtcagaatctcggtattccctacacagaagacctcaacacgcgcaaaggaacactgggcgctacggagttcatgggcacggtcgatgcaaagggcagccgaagcagtacggccaccgcctatcttaccccagacgttctcgctcgcccaaatctgacggtcggggtgcatgtcagagcggagagaatcatttttacggacatcgacggcacgtcccgcgcttcaggcgtcatccttgcgtccagcgcaacgggcgctcgctatggcgtgctcgccagccgcgaggtggtgatgtgtgcgggcagcgtggcgactccgcaactgcttatgctctccggtcttggaccttcggcacatctccaggatctcggagttaccgttgtaaaggacctcccgcatgtcgggcagaatctcgctgatcacattgcgaccggatcgctggtctttcgcgctaagccaggcaccaacatcagcctagactatctcgcaaaaccactgaacggtgcaatagcgcttctcaagtggttactcactggacgagggcccatgtcctgcatcgccgccgccgccgccgcgttcattcgttctgatgatccagctctgaaagaagcgttctcgtcaaacgcatctgctaacgtcccagtgcgcgatcgcacgtctggccctggtgcgccggacatcgagattacatggggcgccatagtctcgctcgacaatggattcaagaagcctcctcctggttgtgaggggctcacattcagcgcgattgccctacgtcccgaaagcaccgggtcgatcaggctcgcctctaggagtgtctgggatgcgcctgtcattgatgcaaactatcttgcgtcggaaaacgacgtcaatgtgctcgctcgcggggcgcgtctcatcatgaggcttacgcgcatggagccacttgcggagctcctcgaatttaagcttgtcgccgatgagtccggcgaggacgtgttctggcctggcaatacagatcccgacgaggtatcggatgaggctctgcaggcctggatacgcaaacatgcatgtccggtcttccatcctgtttcgaccgcccggataggcacaaacgcagagaacagcgtggtggacgcgatgctgaatgtgcacggcgtgctaggcttgcgtgtagtggatgcgtctgtattccccacacaactgtccggccatccgtgcgccgtcgtggctgcaatggccgaacgggcggtggaactgatgcaggaggaacgctga

SEQ ID NO: 459 - DNA, 2844 bp, Gelatoporia subvermispora
atgcccacttttgcgctcttaccagacttcttcacttcccagtgcattgagcagcccaatggtatcttgtactacgttgttcacgctcatgatagtggtcttggcctcgatatctaccccaaaagcagaatcgaagttcttcgggacgctcaagcagctgctgggtatctgcaaaaggctggagtgaagccaagggtaccaggaggaccggctcagactatctcgatcgtcatgcgacatggctacgcatgtctcacgatgttcctcgccacatcgctgaatcgctgtgcaccggtactcatctcgcctcagaataccacagagatgatcacagctctagcacaaacttcaaactcaacagcgatcatcgtggacaatgaccacattgaacttgcctcgcagattcagcaagaaattccttcgattctcgtagtacactttgaagctttcaatgcttcccgcagtgttccgcccacaaacgttaatttcttgccagcgcttacggaaaggggttatctggctgagaaggataccgcctgttattacatgcacacatcgggatcaacgggtcatccgaagctcatcccggaagtccacagcagctggtgggataaggtccatcgttatgcagtacaagagcaaggtcacccggcggtagtaatgacgcaccttcagcacacgcaaggtattctacggtttatggcattaccttggttatctcgcgatattcctgttcttgtggaatccaagcgcccgttcgatggggatctcctttgccgcctcctccagcagtttcccggagccaccctttggaaggcgagagaacttgtcatgatgcagctgaacacgacattattgacacagcacgacagtacggaaactgggcagctcaccatcctcgacatcgcctctgatgacccgcttgattggccgtacatgagattcctcgacgaacatcagatctacatggtccctgtttcgggatctgacggtgtatgtcagcttattgtcaaggctggacgctttgtgcctgcagatctagtcaatttctccgatcctccaggctatttcagcggtgatttgttcaaagctcatccagcgaagaaaggtttgtggaaacatgtgggacgacgaggctcagtgactgtcctaagtaatggcaagaaaacggacaacggtcaaatacgttctctcataactcgaagcccagcgatacgagatatcgtcgtcttcggagaaggccatgtccaaaatggagtgattatttggccagcttctaccttttcaaaccatgaaacgaccattgacaccctgtggcctgtggtcaaaagtgcaaacgatgcgttgcctccccattcacgaattgtgaaagaactcgttatcgttgccagtgcctccaagccatttgcgctctcggataaaggtagcgtgcgggaattccaaacgctgcgcctttacgagcaggagatagagaatacgtatgcgagtcttgagagtggatccgtcaatatacctctaccacttcatgatgatggtggtggaatcttgacatacatcagggatactgtacaacggcttatggggaagaatattgacgataccacgaattttttcgactcgggccgcggctcctcaaatgacggccacccagagcaaattgacctagaacgccttatatcgaatctgaacgattcgtggagttctctggggaccattgacgcacgttctcctcaaacagactccaatgagccatgggtcattcttctgactggttccaggggagccctggggcgtcagctcctgccacttttcgtagcatcacagcgagttcatgccgtgtattgtttggatcgtcgcttggacccttctcgtgctacgacatattcaagcatgcctaccggtaattcctctttaccatcagggaaggtcaggcgctgggagatggatatctcactgccgcacctaggtctgcagggtgagccattgcagctggtgcgggaacatgtgactcacatcgtgcattgcgcatgggaggtgaactttaatcacccactggaacgattcgtgaatacacacatcaagggtgtccaaaccctcatcaatatcgctatatcgacacagcgtgccactttcccccggctggtcttcgtatcctccatcgccgccgtacgcaattatgctggcttgggaaagattgcggagcgctgctacttcgactcgaggattccttccgacctaggttacggacaatccaagtacgtcgcagaaagaatcctcgctcacgcgtcggagaagacaggactacccatcaccattgttcgagctgggcagttgtccggatgcatgacaacgggcgaatggaacgaacacgaagttttccctatatttttccgctcgtgccatctacttcgacgtatccctgatcatgcagcggatgcttgttgggtaccaattaacttagcggcacaagccatctttgatatccttcagcatgacgctagcgccagtgcgccgttgctgacagtacgacacatcgatagcgcatacgcttgtgaaggatctcgcttggtccattggcttgttcgggcgtccggtggtacgctggagacagtatcggtcgaatcgtggatacaggccgtgcaagaggctgaggaagatatacccgccaaacgacttcttcaagttttcgacgcctggaagtccgacgcgaatcaaagcgcctccaaagctctatctgtggagagtaccagagagatatctcaaatggctggcgggatcccacttacgtacgagctggtgtctttgtattggcgtcatgccacccggcagctgtctgtgacctag

SEQ ID NO: 460 - DNA, 681 bp, Gelatoporia subvermispora
atgtcgctcctgaacgctgcccgcaccgtcgcgcgcactcgtgctgcgccccgcctcaacgccgccgcgctgtccgtcgccgcgcgtggtgttcacacactccccgcacttgattacccgcatgatgccctcgagccgcacatctcggggcaaattatgaagctgcaccatgagggacaccacaaggcatatgtcactggcttgaataccgcggaggaggcgtacgcaaaggcgagcacgcctaaggcaaagatcaacctcctccccgcgctcaagttcaatggcggcggacatatcaaccacacgctcttctggaagaaccttgcgcccgtatctcagggcggtggtgatctctctcagggcccactgaaggatgcgctcgaggcggacttcggttctgttgacgcattcaagaagaagatgaacactgtcactgcggcaattcagggctccggctggggatggcttggctacaacccgtccaccaagaagctcgaggtggtcacgacggctaaccaggacccgctgctctcgcacgtccctatcattggtattgacatctgggagcatgcgttctacctccagtaccacaatgtgaaggccaagtaccttgacgcgatctggaacgtcatcaacttcaaggaggccgagcgtcgctacattgaggccgccaagcagtaa

SEQ ID NO: 461 - DNA, 1599 bp, Gelatoporia subvermispora
atgtcaaccatgcaggaatccgacaaacaggaagtagctgaggacaccacctataccacgcagcggttatcggaggaggagctcaaggcatttcttgtcgagtttgggcctcaagatcgagacaatcctaagaattggtcccggagcaagcggtggtatatgacgatcgtggctagcttaatcgcattcaatgcaggagtagcgtcatctgcaccggctgggatcgcctccaacctggctcttcaattcgcaatgtccgaagaattggtagttctgtgcatctcattgtttgtgactgggtactgcgttggcccagtactatgggggcctttgtctgagcagtatggccgacgactcgtattcttgtcaacgttgcctgtttatacttgttttcaagtcggatgtgctctcgctcacaatcggacgtcaatcatcgttttacgcctcttggctggtatattcgcggcagctcccttcacaaacagcggtgcaattatctcggacatgtgcgttattcggacatcgttatcaaacatcatatgcatgcctcatctgtgcagttgggacgcgagtactagaggaaaggcaaacatcctctttgcgaacgcgccattcattggatctgcgctcggacctctcgtcggcggctacatttccgtttccgggatttcttggcgatggaccttctgggtcttgacgatcttcgtaagtttgatgcgcgaaatgtttcgcatgaatgaacacatcgtacagaatggcctctgcatcacccttgttgttacctctctgccggagacatacccgcctatcctgcttctacgcaaagcgcggcaaaagcgtgttcaaaccggtgatcaccgctactacgccccaatggagacgtatcacctcgtagcgttctcggatcgcctcaaacagactctgttgagaccgttcaagatgctgtttcaggagcctatgctggctgcaaccaccgtgtacacaagttttatctacggaactatgtatatggttttcgaagcctttcctagtgtttatcaaggggagcatggtttcaatccaggtactctaggtttgacgtatctcccggtagtatctggctgcgtgactgctagctttgtttaccttctcgtgttcaatccacgctacgaagctgcagtccaacggtataagccgaaccatgtgccgccagaagttcgtctcgagatggccatgtggacatccccactttatgctattgcattcttttggtttgggtggacgtcgttccctcacatcactgtttggggaccactgtccggtgctttcttccttggattctcctccatactcctgtttctgtcacttatcaattacatagttgatgtctacctctttgctgcggcatctgccctcgctgcgaatactgtcgttcggagcgctgcagcaggtggtctcccgttgttcgctccgaggatgtacagcgcactcgatcctcgttgggcatccaccattctgggatgtgtcgccttactgatgatgccaataccttttgtgctctacaaatatggtacgaccctgagggctaagtccaagtttgcgcctacgatacaccgttga

SEQ ID NO: 462 - DNA, 2499 bp, Gelatoporia subvermispora
atgtttatggtggaagatgaagatgtccagaaggattttacccccattccaccatctcctgacatggagaagactggattcgtgtgcgatacatcaggcaccaccgatgctttagattccttggatgctcctgttatatcgatccacggtgtacaacccctgccggctgacccgaacgccgctcttgctgagctccctcaagagctcaatccacgaagatggagcgtgtctcgcaaatgggtcaacgttagcatcatcgcattccaagcaacgctctccccgatatccagcactttactggccgtaggacaggtgcaaatagacgaggagctaaccgtacgaaacactcagctctccgcaatgccagtcgccatttacattcttggcttgggactgggaccactgtacttggcaccgctgagcgagatgtacggacgcaggatcgtttacgttacaaatgccatcatctctttcctcagcactatcggttgtgccctagttcaaaatgacacaggcctcataatcttgcgacttgtagcgggactggcgggcggtgcagggccagccttgggaggcggctccatcggagatttatttgaacgtgaagatcgcggcggggcacaggcaatatatagttttggaccgacgttcgggcccaccattggaggcgtaatcggaggatacattgcagagcgtgtaggatggcgttggacaatgtgggtttgcgccattgcgagcggaatttcggctattgcgtccgtcttgtttctttgcgagagctatgcaccatatctcctggcccgtcaaagaggacaaaagtccgcgccgacgaccactgggggacttgctcatgcgctcactcggccaattcgcatgctactttttgcgcccatcgcaaccgccatgagtctatacgtcgccgtagtgtacggtctattgtaccttcagctcgtgacaaggcctctgctgtttgggcccgagccgcaatacgggctcttcacgtacaagtggcacggtggcaatactggtttgtcctacctcgctgctgctgtcgggtgcatttttgccttgatcgtatctgtaatgggaatgaaccggtcataccgtgcgctatgcaagatatacgacacagagaagcctgaatttcgacttccatttatgcaggccgggatcctgattgctccttgcggactttttatatacggctggacagcagaggcacagacacatttcatctttccgctcatcggggccgctatcttctcgttcggcgcgctcgttgtactgacatgtgtccaaacctatctcgtcgatgcgtttgggaaatttgctgcatcggcgcttgccgcatcggttttgtttcgtagctttggagccgcattgttcaccgtattcgggacaagaatatatgcaagtctgggatacggctggggatccagtctactggcattcatatgtctcggcgcattacctgtcccggctattttgtggatatatggccctcagatacctagcgataccgtgtcatccgggtggcaggtcctcaatccatctgtcttctcgacgtctgtggtcggcgcaagccttggattgtcgcagttctacgcggatgcgctggcaatctacggaacgtcaggatatccatttgaagtcatgttggatggtgtcacatcgaccgatccgactgcatctggtcttctcttttctcaaaatacaggaaggggtgcacacaacctcaacatcactgctagcgcagtcgatgcctccggtgctcaatttgcattcgaatatgcagtccttacgagcgactacaatgcagatcaagctccggaagaagtagaactcgatgtcgaagatacccatctagtgtattcgtccaactggttcataattctcaacggcacagctcacacagagaccgtcaacgcttccgtgtccttaactttcaacggaacggcgatcgcagtggctgggccaaccggtactgagctcaacccaggtgattatacgatcattttggatggacttccatggaccttttcgaataataccttcggagtggaggaaacggatcttttcttccagagtggcctcacgagtgatgaagagcacacaatcactctggtcaacagcggtggccgggttgccttcaactcgatgaccgtgtggcagatcagtatgctaagtgccgatggctcaagcagtaactctggctcagggccgtctcgtgccagtaccaccaaggtcatcgccccagttgtctccatcatcggcgccgtcatccttctcggtctaattctgtgggcacgacgacagagaatcctgcgccgacgttcggccattctcgcaagcccctttggaatgcgtctcgtgcgatctctgggccctgatgtatctggttctctaagattgaccgagctgcgagcgagcgagcgatcggatccgacggatgtagctgtagtgcacggaggaggcaccatgaagcctcgcgaggtgtaa

SEQ ID NO: 463 - DNA, 792 bp, Dichomitus squalens
atgaaaactatcttcttccctataacgcttttcgcatggtgcacagttccgaacaccaactcattggcctttacgcgctccgccctctggacatggcttcatctcctccagttctgtgtctccaaccagagtctatccccagacgaggacgcgcagaacaagccatggagaccgattcccgccggtcgcctccctgtacgtcaggcgactaggcttcgatgggccctcctgccactctgcctgttcctgtcgttttccttcggcatcccggcggttggtgccgtgttgatggttggcattctcctccataatgagctgaaactcgactcccattggttcacgcgaaacgttctgaacgccattggctatgcaacattcgacgccggtgcgatgacagtcgctcaagctggcgcgcacctctcattctcgtatccggccctggctgcgcactacacgagtatcgcgatcgtcctaacgacgatccatgctcaagactttcaggacgaggaaggcgacagagtccagaagcggcgaacgattccgatcgtgatgcccgccgccggacgcctctcaatgccggtcgggcttacgctgtggtccctggggttgagcgaaggatggcacctcccgaatgcgcaccgtttggctcttatcacaataggcctgtatgtcgggtcgcggttctacttcctccggtcccctggcgcggacaagacgtcgtacaggctctataacgtttggttggcgattgcgcgtatctcgcctatgtatggacggattcccgtgatgtag

SEQ ID NO: 464 - DNA, 1578 bp, Dichomitus squalens
atgtctttgctcagttccctcgacacctggatgcttgcgctggtcgtgctgtcattctccggcgcgctcctttgcatagcatatccagatcgcctcgtcaccacaaatgctcgccctgacctcccaggtcctacaggacaccctctatttggcaatctactccaagccattccttggcaaggccgcatcctcgattggttcgaccacctcctgtcgagctatggccctttctgcaccttcacactactgccgtgggggagaggcatactcatcaatcgtcccgagtggctcgcccacatcaaacaagccgatatgaaggcgtactcgcgtggaccatacgcgatcgagatcttcaccgagtttccaggagggaggactcctgttgcctcagaaggggctcaatggcgacttgcaaggaagtcgatttaccccatcttcactgtcaaatctttcactgagcacgtctcgcatgccatgaacgagattgtgccaatggctcgagcactgctacttagcgcgagcaagagggacgtgccgatagattggagtgacttcgccggtcgtatcgccattaccatctttacactttcgcacatgaaccaccatgccaacgtactccagggcgacgtcacttgcttagaccgcgatgatccactccgcgatgcactggctgtgctcaacagggtttccgcgaaacgactattcaaccctgcgtggcgcttcactgagctcctcaatggcgatcgtttccgtttctcccgtgctcggtcgtacatccgcggacttgtcgaccaaatcgtgcgcgcacgacaagcccatgccaccgagaagtccaaggagaccgcgccgggtcatgccgacttcctctctgtgctcctggaagaccctgctttcaacgatcctattctcatccgtgacatcatggtgaccatgctcttcgccggccgggacaacactcagaacgtcctcgcatgggcgctctattccatcatggcggcgcccgagtggatcgaccgcttacgtgaagaagcgaccgcgaataggcacccgacgcatgaagtagactactctgaagtatcacgctaccacgtccacctcgctgtattttttgaaactgtgcgcttgtggccaggcttgcccaagaacgcacggttggctctacaggatgacgttcttccggctttgccagagtatgatctgcctgcggtgaagatcgagaagggtgattatgtgttttggtctgactatcacatgatgcgtagctcgggtgtatggggaccgacggccaacatgttcgaccccggacgtcatctagactccgaaggtcatttcaccaagcccgcagcacccaagttcaactgtttcggcgcaggaccaagattctgcccaggacagcagctcgtcatgtacgagttcgtcgcagctctggccggaatcctcccgtatttcgactttgctccctccgagcgtcccacgacgtctggattgacttacgagaagccggagctagcagaggcgttcacagcatctttgactgtgccactgatagtcgacacgaagatcaagttggaatactag

SEQ ID NO: 465 - DNA, 1632 bp, Dichomitus squalens
atggcttacaccgtgggtggtgtgcccatttccttggttgctggctttgtcggccttgtgtggttggtccgcaagaagctcattgccatctatgtcacccccatcgtggctttgagaggaccacctagcccaagcatattgtatggcaatttccagcagttgggcaaagtcgcggaccccactcttctccagaagtggatggacgactatgggccgacattcctcgcacgattgttcatattgatgccgtgcttatggacggctgaccctcgagcgatcaatcatatcatcacgcaatccggaaagtacttcaaacccagagatggccgcaagcaagccgcgcaaattcttggagagagcctcattattgccgaaggggaatctcacaaacggatgcgcagggtgatgaaccctgcgtttggcccagcacaagtccgcgagttgacatctatatttgtggagaaggccactgagctgcgcgagtactggaagtctgccatggttaaagaaggcggcacgcttagagtgaacgttatcgaggacctcagcaagacgacgcttgatgtgatcggattggcaggattcgatcacaacctggactcgttgaagcccgggagcgaacgcaaggagctcaatgccgctattcggcatctcttcaaaaagccaccaaacatgacggtctttcgcgttctgctagattatgcgccttggctgaacctctttccggatgagcgcctgcgaaatctcatcgaggcgcagaaagttatgcgtcgcgttgcacggcagctcatcgaagacaagaaggcagcgatcaaggcgtcatcagaggacgacgagcatgtcgggcgagggagcgttcatgggcgcgatctcctcacgcttctgatcaaggcaaatatggcatcggacattcctgtagatcaacgtttgtcggatgatgaagttttgtctcagattccgaccttccttctcgctggccatgaaaccacaagcgtagcgactacatgggctctgtatgccctaagcgagtcccctcgtatccagagaaagttgcgcgaggaactccttgcagttcctacggagactcctacgatggaggatctgcatgctcttccgtatctcgaccagttcgtgcacgagactctccgcttgtatcctccggtgacgaacacaatgcgcgcggccaacgaagatgacgtgatccccctcggggagccgatcatcgacaagaaggggaacgtactacatgagataccagtggcaaagggtactcgtatcgtgatccccattcttgcagttcacaggtcgaaggcaatctggggcgaagatgcccttgaattcaagccggagcgctgggagaatttgccggaaacagtttccagcgttccgggtgtctggggccatctccttacgttcctcggtggtccacacggatgcatcgggtacaggttctcggtcaccgagctgaaggctctcctcttcgccctcgtgcgcgagttcgaattcgagttggccgtgccgcacggagacattgtgccgatgggactgctggtgcagcggccggtcgttcggaacgagctcaacaaggggtcgcagatgcccatgataatacggccataccagccgtcgtga

SEQ ID NO: 466 - DNA, 1392 bp, Dichomitus squalens
atgtctgtgctcaatacactcgacacctggactctcgctttggtggtgctgaccttttctggcaccctcctttacatcgcgtatccagaccgtctcgtcacgaccaacgctcgcccggacctcccaggaccgaagggccatcccttggtgggaaactctctccaagccatcccgtggcagactcgtattctagactggttcaaccatctcctgtctgactatgggcccgcttgcacctttaccatcctaccatgggggagaggcatactgattaaccgccccgaatggcttgctcacataaagcaagctgatatgaagatgtactctcgcggcccatacgccaataagatcttccacgagttccccggaggaagagcccccgtggcatccgaaggcgcacagtggcggctcgcacgaaaatcgatctacccaatcttcacagtcagatcctttactgatcatgtctcgcatgctatgaacgagatagtacctattgctcgcgcgctgctacttagcgctagcaagaagggcgtgcccatagactggagcgacttcgcgggtcgtattgcgatcaccatctttactcgttcccacataaacgaaaagacgaatattctggaaggggacgtttcgtgcttggaccgtgatgacccactccgagatgcgttagtaacgctcaaccagatttcggccaaacgtcttttcaatcccgtctggcagtggtcagaaatactgtcgggagagcgttggcgcttcaaccacgctcgctcctttatccgcaggcgggtagaggatatatgggtggatcgcctgcgagaggaagcaatggcgatcagggacccaactcgggaggcagaatactctgaagtcgcacgctaccacgtccatctagcagtattctacgaaacggttcgtctatggccagggctaccgaagaacgctcggttggctcttcaggacgatatactcccagctctcccagagcataacctccctgcggtcaaagtagagaagggagactatgtcttctggtcagactatcacatgatgaggaacgaagatgtatggggaccaacggcacacttgttcgaccccgggcgccacctcgatgccgagggacatttcgtgaagccatctccggccaagttcaactgtttcggcgctggaccgagattctgccctgggcagcagcttgtcatgtacgagttcatcgcttgtctctcaggcatactcccgtacttcgatttcgcgccttccaagggcgccaccgcatctggcttgatttaccagaagccagagctcgctgagtcctttactgcctcgttgaacgttccgctcgtggtagatgttcgtgcccgcgatactctcgaggtgcttgaaggccgtttgtga

SEQ ID NO: 467 - DNA, 1128 bp, Dichomitus squalens
atgcagacccaccaccagacctcgcagtcgttgaatgcgttgctggcgccattcagcaagcagttccagaatggcctcctgcggcagggtacatcgtctgtgccattgctgacgaccatgtcgcaatactacatgctccagccttccaaacgactcaggccttgcctcatcctcctgatgtgtcaggccacgaacgggcttggctcagactgggagaccaagagcacgagcttgtgggtcggctgctcagccgaaactgacgctctcgagaacatacttcctgagcagctgtcgctcgcccaggtgtttgagattctgcacgtcgcgtctcttctgcacgacgatgtcatcgacaacgcggagacccgccgcgggtccccatccgttcccgccctctttgggaaccgtcgcgcgattctcgcaggagacttcctcctcggtcgcgccatgcgcctcgtcgggacgctcggctcgccagaggtcatgtcccttgtcgcagaggtcttctgcacactcgtcgagggcgaactgctccaggcaggctacaccgacctgtccctcggcagtgctgtcgtcgatccggtccaactcccgagagtcgcccaggatccggccgaagacgaaatcatcacgtccctctggcaagagtacctacaaaagacatacatgaagacggcaagcctcttcgcgaaagcgatggagtgcgctgtcatactcgggggcgcgacggccgaggacccgttgagagaagcagcatcttccttcggcgcatgcctgggaatggccttccagatcgtcgacgacttgctcgacttcgagggcgatccgaagaagctcggaaagcctgcgaacgcggatatgcggctcgggctggtgacggcaccggtcttcttcgccctgcaggaagacgagagcatccgtccgcgggtgcttcgttgctttgagggaccaggggatgtcgaggtgacagccgactgtgtgcggaacactcaggcgctgagccgtacccggaagctagctgaatcttacgcaatgaaggcgcgcgaggcactgaatatagtccccgacagcgctgcgaaagaggccctcttgaaggtcacgtttgctatacttgcccggcaggcttga

SEQ ID NO: 468 - DNA, 1818 bp, Dichomitus squalens
atgggtgtgctaacgtcgaaggctgccccggtcagcggcccctcatcgattgctactccctggactcccactgtgagtagcgtggtttccaaagtagagacggagcactggaagtcctttgactacatcatcgttggtggaggcccggcggggtgtgtcctggcgtctcggttgtcggaagaccggaccgttagtgtcctccttgtcgaggccgggaagagtcacgaaggcaacctgttctcgcggattcctttggcgtggaacaagctactcaagagcgacgcggattggaactatgatactgccccgcaagaaaccatacatggccgtacggtatattggccaagggggaagatacttgggggcacaagctcgatcaatgccatgatataccaccaatgtcccccagacgacttcgacgcctgggagcgacgaggtgctacgggatggggatatgcaaatctgaaacactatttcgagaaagcactccaggatggtccacggaaaagcaaagtcccactgctcgctcctgtgtgcgccgccgttctgaaggcggcagaagcgctgggcctgccaatcgtcaacgacttcgataccgaaggtactctgggtgccgggccattcgcggcggcagtgcatcgcgctgagcgaagctctgcggccgtcgcctatttgagcaaggaggtccgcagcagacctaacctaaccgtagtggtgtcgaccttcaccgagcgaatcctgttcaccgaagacctcgatggcgtgcccagggcgatcggggtacagctctctacaggtcctcttgctcgcaggttcgccgtccgcgccaagcgggaagtgatactgtgctctggtgtcgtaggatccccccagctcctgcagctctcaggcatcggagacgcgtctcagctcgagcagctgggcatccctgttgtccgcgatctgccgtccgtcggacgcggcttgcttgatcacttttccgcaggcactctggtacttcgggccaagcccgggtgcacatgggaccaccttacccaaaatcccctctacgcggcccttgcgatgatgaagtggctcttcttcggccgcggtcctatggcgtccctcagcgcccagatcggcatcttcaccaagctgcacgacccgagcttaccgtacgggcctacgcccctccctatcaaggacctcacctctggacccaacgctcccgacttggagttcatggtcttccccgtggctgtgatcaattatgggttgggcttccctcgtctcgggaactacgggatctctgtgggtgcggttctgctgaagcctgcaagcactggcaccgtctccatacgatcgtctagcgtatacgatcacccgaacatcgaccccaggtacttcgaagacgaaagcgacctgaaggcgctcgtccggggcacgcgcttcatcctccacctcgcgcgtactgcgcctctatcctcggccctcgacctacgcaatctctccactgcaccgcaagaccccgacttctactggcccggggacgccgacccagacaaggtatcggacgaagaactcgaggcgtgggtcaagacgcacgcgacgtctgctctgcatccgacatcgtccgcgcggatgggcaccgacctgacgacgagcgcagtcgacctcaggttgcgggtgcacggcgtgcgctcccttcgcgtcgtcgacgcgtcggtgtttcccgaccaagtctccggccacccctgcgtgcctgtcatcgcgatcgccgagcgcgctgcagacttggtcaagtcggactttcttgccagccagcttgcgcggtcttga

SEQ ID NO: 469 - DNA, 1845 bp, Dichomitus squalens
atgggctatggtcactcgagacttcttgcaactgatccatcgcaatacgctacgccgtggtctcctgctgatggtgctgcggtgatacctcctggagaatggaattcgttcgactatgtcatagttggtggcgggactgcgggctgtgtgctggcctctcggttgtctgaagatcccagcgtgacggtacttctcatagaggctggaacgagtcaccgaagcagtttctttagccgcatacccatgggtttcccccgcctattcaataccatctatgactggaagtaccgcactcaacctcagcgggagcttggtgacagaccagtcgactggcagcggggaaagatacttggcggttccagctccatcaatgcccagctgtaccatgagtgcgacccagcagacttcgactcgtgggagagccaaggtgccacaggatggggctatgaatcgatgagaaagtactttcggaaggcggaaaggtatatgtcgcacccttcgcaccttgtcgatccatcgggtcatggacgtgatggtccttggatcacctcacacgtgccaatagctcctatctctgccaaggtcattgaggctgctaagacgttgcgaataccggcttcaaacgatttcaacacttcggagggaacgctcggtgctggttacttcgtcgccagcattgacgagaaacatgaacggacttccgcagcaaccgcgtacttgagggaagaagtcttgaaaagaccgaatctgcttgtcgcaatatctacaactaccgagaaaatcttgttctcgtccgacgagacgggcgatcccaccgccgtcggcgtgcagatcagtagaggcgaacgagccgcgaagtacgttgtcggcgctcgcaaggaggtcatattgtcggctggggcgatcgggtcgcctcagctgctcttgctttctggtatcggacctcgtgcacatctggagaagctcaacgttcctgtcgttcgcgatctccccaaagtaggccagaacttgctggatcatttctctgcaggggcgctgctgttccgcgcgaaaccgggcttcacttgggattgggtcgtttataatatctactggtcggctgtcgctttggtccaatggctcattcttggaaccgggccactctcctccctggcaacgcaggtcggcatatttgtgcgctcggatgacccaaacctcccctacggggagtcgcttcctgtcacggatatgagctctggccctcgtgcaccggacatagagtttgcgattgctccgtttgttgtcattgaaagtggcgctcatacacctcctcgcgggactcatggcatcactgcgggctctgttctgctgaaaccgtgcagcaaagggtcaattgaactacgttccgcaagtgtgtacgatcaccctatcattgatcccaactacctctcgaatgagagcgattggaacgtcatgatcagggcgacacggctcttgcttcggcttgcaagggctccgccattgtccgacgcgctggaccttcggacgctgtccgcacccggagacccgctattctggccaggcgatgcggacccggagaagatcatggacgaagagatcaaagcagtcattcggcgctacgggcaatccgcatggcacccgagacagacgtcttctgcgcgaatgggctcttctccgcatgacagcgtggttgatatcgagctgcgggtgcattgcgtgcggggcctgagagtcgtggacgcatcgagtttccccgaccaagtctccgggcatccctgcgctgttgtggtggctatggcggagaaggcggcagaactgattgcgacgtcacgttcgcaaggatga

SEQ ID NO: 470 - DNA, 318 bp, Dichomitus squalens
atgggctgcggcggggatgctccgcgttctctgcacgatgcagcactcgcacaaaagcaagaagacgcaagcaaaggacctcgtcggttcggtctcccagatcaacaacggcatctagaccatctgcacctatggcatggcccgtcgtcctgcgcgccctccccaagcctcgtgcacttcacgtccgacgaccagctcacgcccgtcgtgaactcgcacaacatcgacgcgcaaggccagcgcaacctcgaaggcgaggtgttcgtgctcgagatgtacgccgcgtggcgcgactgggctgcgatcgggtcctcatga

SEQ ID NO: 471 - DNA, 987 bp, Dichomitus squalens
atgagtgccgttcttgagggagtgctactgcaacagacgtttcgatactttcaaatataccgctctgatccttggtacctcaaagtctgggtcataatcgtggtggggtctcaatcggctggcacggcactcactatgcatacggcttatttctacctggtcaccaattacttcaaccctggtgtcatcattgcgggtgctgcaatctccgctaaggtgttacccttcattggagccgtaacaaaccttgccgtggaactcttctacgtcaggcgggtgtacttgctcggacgtcgtcacaaattcttcgctatattctcgctactcctgattctcactggaatcgcgttcctcattgtcctgggtgcggaaacgttcaaattcaatagtctccagcaggatacatccaatggcgggcttggtggcagttcaattgcaagcccgacattcatgctggctgcagatgtccagttgacaggtgttctcatatttgccctacacacaagtcgcagtggtatttctcgtaccaacaagatgatcaacatgattatcgtatattccgtcagctctgggttcctcatctgtgtagcgaacctcgtctccatcatacttgctgctgtacagcctcacagtgtccttttcactgtcgccacgatggtcggaggacaaatatacagcaactctttcattgttgcattgaacacacgccgcctcgtccagaggcgcggtgacaagccaacgacggtcatggacccctcgaaaactgacattctgcaaggtggtcctgggtccggaactgcgatcggtgatatggagctggagtcgatggcgttcgctggaggggccatttcgactcaactgaaggactccatggcccacggagactctactgcagtgttggacttcaagataggaacgctctccacaaatggtaccatgccagtgatggacgagaaagcaggtccggtagaggaatgccctgtgtaa

SEQ ID NO: 472 - DNA, 987 bp, Pleurotus ostreatus
atggccacgtactctagccgtcttccttctcctctcaagcctttggaacacatctggcgtacggcatacgcttttacgaagtctgactacaagacagtcgtcttcccagtcatctgctatgggataatggctgctccacagatgtccatcaccagacttcctcacctcgcggtatgggtgtggcttcaccttctgcagttctgtgcagcgaatcaggcgttgagccctgaagaagacgcattgaataagccgtatagacccatcccagcgggcttaatttcgattcggggtgccagagtccttcgttggctcctcgtcccggtctgcctggcgctctcgtggacgctggacgttatctacccagggatcagtctagccatctcgttcgtcgtctacaacgagctcggcttggataactactggtatacgaagaacttcctcaacgctgtgggcctcgtctcctggaatatcggcgcggccaagatcgcatgtgcagagaatgtttccctcgaccagcgggcctggtttgcgccttacgttagcacgcttcttatcgctacgacgatacatatccaagacttccgcgatgaggcaggagataggaaacagggacgagtcacattccccgtcgtgatgcccgaattctctaggcgcatgacattcctcatcgtcgcagtgtggtcgttcggcctcgcgtcgtattggaacctaagcagcgtcgcatctccgtggttcgtcacactggggatgtacgttgccctcagagtgctccagcagcgcaccgagcacgaagataaggtctcattgcggatatacatggtacgttgtcatcccccgaacgcacccacttcatccccgcctaacccgataacctgttcagttctggctgtgcgttgctcaaatcctccccttctggacaaggcaaatggagggaatagcccagccgtggctgccaaatgctcagttcggggctattcagaacaatga

SEQ ID NO: 473 - DNA, 1536 bp, Pleurotus ostreatus
atgatgcgtacttcgtttgcaatcctcgcggcgattatcccgctaacattcacgtttggtgcttcggtagagaatcttctgcccagaaacaccacccaaaagcaagaccttacaccagctcaatgctgcgacggcctgaagcgtatcttagacccttctaaagtccttctgccaggctcccctgagtatgcggctcaggaggcctcctattactccggcgaacaggtcctacagttccctgtctgccgagtcgcacccaccagtcccgaagacgtctcaagtataatcaaatttgctaccacaagtaactgcaattttgccgtacgttcgggcggtcatatgaactgggttggttcatcgaacatcggtcccgaagggtttactatcgacttggaggacatgaagcagattgagcttctggacgattcgaagactgtcgctatctccccgggattgacctgggccgatgtctataccttcttacgtccccacaatctgcatactgccgggggccggtcgtcccacgtcggtgtaggtggcttccttcttggaggtggcatctcattcctctccctcgagcacggtttcggaagcgacaacatcatcaactaccaaatcgtcttagccgatggctcgatcgtcaacgccaatgaagccgagcgaagcgacctgtactgggctctcaaaggtggtagcacgaactacggcatagttacccgctttgacatggcgacgttcccgttggatcaaatgtggggaggatctctctactacaacatcagcctgggccctaccctcctcgattatctcgtcgggtttacggagagactcgccgtcgatgccaatggcctattcgcgctgtctatcgcttggaacgcagccaataatgattacctcatttggtcaccgaacgcctacctcgcacctacacccttcccaagcccactctacgatggactcgaggaaatcccgacggtgcgcgataccatgcgcatcacaaacctcgtatctgtcacagacgaaatcaatatgtcatccccaggcggaagccgaactcagtggttcgctttggtgttcaaggcagacgcgaccctgccttgggatatctatcagaagggcgctgatattatggcgccgttccttgggaaggaggggacctcgtgggcgctcacgttacaacccattaatgtcggcatgatcgctgctgctgcgaatcgtggaggaaacccattcggtctcaccgaaaaggatggcgatctattccttcttttgatatccatcttctggactgacccagaggacgacggaaagatcaaggctacgacgcaagacttcctgcgatggtcgacggacactgccaagcagcgcaaccttctcaatcgtttcatctacttgaactacgcgttggatacgcagccagtcttagcgagtttcggggacgagaacgtcaggcgtatgaaggccgtgcagaagaagtacgatccaaagggtctgctcaaagtgtggaaaggtggatacaagcttgacgaagtatag

SEQ ID NO: 474 - DNA, 1617 bp, Pleurotus ostreatus
atgagcgcgaatgtatcatggatccccacagcaccggcgacgttctggtcttcaccaaacgaccaattctctacatggcctaagctcgctgtgttggcgttatccaccttcatcattcatcgactgtacaagtcggcgtcgttgaacatgaagctgccccccgggccaagggggtggcccgttattgggagtgtattcgatattggaccacatatgtggctcacgttcacagagtggaagaagcaatatggaccgattttctatgtgaacctcgcagggcgttcgatgatcgtcttgaacacccacgaagtcgccacggagctccttgataagaggtcgtccatctactcagacagaccccgccatatcgtcgcctctgagatcatgtcaggcgaatacctactcggattcatgcatttcgacgataagtggaagcgtgtcaggagaggttctcatgaggcgatgaacaaccaaatcaccaaaacctaccgtccgttcatgcaagtcgaaggatacctcctcgccgacagcctcatgaaagcgccttctatgtggaacgatcacatcaagcgttctgcggcatctttcatcatgtccgtcgtatacggcaccaagtccatgcgcacctccaccgaccccaccctcatcaccctccacaagtttctgaggagatcgctcggcgcggccgctgggaagtactgggtcgagttcttccactttttggagtacatgccaaggtggttggctccgtggagggtggaggccgaggagtggttcaagacggacagcaagatgttcgaggggttctacaaccaagttaagaagaggatggccgacggagacaacaggccgtgcacagttacgactcttatcgaagaacaaaaaaagaaaaacctctctactatggaatcagtctggctggcagcggctatgtacggtggaggctccgaatcaactgctggatccctcggctggtggataactgccatggtagtctacccctccgccctccgcgccgcccaagaagagctcgatcgcgtcgtaggccgagaccgtatgcccaccttcgacgactatgaccacctcccctactgcagggccatggtcaaggaggtcttgaggtggagacccgcaacccccctcggtgtcccccatcgcgtggaaagggatgactggttcaacggttacttcatcccgaagggaacattggttgtggcgaacatttggggcatgaaccacgacgagaaagtctacgggcccgacgttcacgagttcaacccggcccgtttccttgaaggatctggaaagcccctgccctcggtctcagataccaaggacgagggccatgttacctacggcttcggccggcgcatctgcgtcgggcgccacgttgccaacaacaacttgttcatccagttcgcgagcatggcttgggcatgcaatatccaggcgaagaaggatgcgcaggggaacccgatcatgcctgatgcggataagtgcacgtcggatttgacgatgcacaccgtcccattcgattgcgatataacaccaaggttccccgaagttccgtccatcattgcccagtccattgagttgaataattacggccaaatttga

SEQ ID NO: 475 - DNA, 1626 bp, Pleurotus ostreatus
atgagccacttctcatggtccaacatctccagcgcagcgccctcttcctcttcatacgctgagctctacccctctctcacgtcatggacactcagtgttccggtcgccatagtgctccttgtagcagcgcgttcctatatggcaaggcctaaggggaagcttcctcctgggccgccaggattacccgtcataggaaatctgcatcaactgacagataagctctgggtaacgctcgagaagtggactaaacaatacggccccgtagtctatctaaatatcgccggccaaaacacaatcgtccttggcacgcacaaagccgccgccgatctcctcgatcgtagagcgggcatctactctgaccgaccacgaaatatcgtcgcaggagagctgctgacgggcggtttggtatttgcgttcgctcagcataacgatgtttggaagcggatgagaagggcatcgcatgaagcgatgaataaccaagtcgccaagtcctacttcccattccaagagactgaatcgtctctccttgtctctgagctcctcgcttccccggacctctttgactcccacctccgccgcgcgtccacgtctctcgtcttatccatgatctacgggctgcctcccatggaagacagcagggaccccgtcatcttgcgggtgaatcatttcacggagagggcgctgaaggcggcgatcccgggcgcgtatttggtggagtacttcacgtggatggagcatttgccgcggtggatgtgtgcctggagacgatatgctgaggatgcattcaaacgcgattccgtcctcttcgaaaacctcttcgctgatgttgtgacccgcctcaaaagcggtgatcaacgccccagcgtcgctgccaccatcatcaccgaacaagagaagaagaacctcacggataaagaagctgcctgggtatctgctacgctctatgccgctggtgctgagacgacatcgggccaactcgcctggtttatggaggcaatggttctctaccccgaggtgcaagctcgcgcgcaagcagagattgatcgcgtcgtcgggcgcgataggatgcctacattccaggactacgaccatcttccatacatcaaggcaatggtgaaggagacgctgaggtggaacggcgtcggcagattgggtgtcccacacaggctggcccaggacgattggtacgaggggcacttcatcccgaaggacacgatctgcttagtgaatgtttggggattgaaccacgatacggaggtctacggtcctgacgtcgatgatttccgcccggagaggttcttgaacgaagaaggggagctgaaggccatgccaacagataccaaggacgaagggcacgtaacctatggcttcggaagacggatttgtgttggccgccatgtctccaacaacagcatgttcatcgagatcgcctctatcctgtgggcgtgcaatattcgccctgggaagaacgaggctggagagatcgttatgccggacccgcagaatagtatcgatgaggggcttgtagtccgtccagcacccttcctgtgctccattaccgctaggtcgcctgaagtcgagactatcctcgctgagacgaaggatcgtcatggtttacctatttag

SEQ ID NO: 476 - DNA, 1521 bp, Pleurotus ostreatus
atgcgcgccgaggcttaccttgctctattcgcactggcgacaaggtcgttcgccaccacccagcagccacttcagacacaaacgtttgacgaaggagtgcggactacagcactacaatgttgcaacgcactcgaagacatcctaacttcctctaccatcctatatcccgcctcatctaaatattccgcgcagtcatctacatattactccctcgaacaagccgcccaaaagccagcgtgtcgcatagcccccgccacaaccgaagacctctcccgattaataaaattcgcgactgccacaaggtgcgagttcgccgtccgcgctggcggacacatgagctgggaaggctcgtcgaatatcggtccaaacggatttaccatcgaccttgggggcttgaaggaggtggaactgaaggatgatgggaagacggtttctatcgctcctggtctgaaatggtcagaagtttatggattcctgaagccacacgggcttcacacggtgggtggacgctcctcaggcgttggcgtcggtggtttccttataggaggtggtgtctccttcctgtcaacggaaatgggtctcggaagtgacaacgttctcgattacgaagtagtccttgctgatggatccatcgtccacgcaaacgagtcagaacgctccgatctttactgggcgttgaaaagcggcagcaccaactacgggatcgtcacccgtttcttgatgcccacaataccccgccctcagatatggggtggctcgctcttctatcacgggagtgcgggtcccaggctattcaagcaacttgctacgttcaccgatcgtctcaaggaggatcctcacggcatgtccgccatctccgttgcgtggagtccagaaatgaaagactacgctatctggtcccccaacgtctacctcgcgccacaagcatacccctccccccttttcgatggcctccaagatatcgagccattccaaagcacgatgcgcgttgcggatctaggcgagatcacggacgaagtagacatgctctcgccgggtgggcggaattcgcagtggttttctgtcgttttcaagaatgatgcagagctgccttgggatattcagctgaagggcagggaaatttttgagccgtaccacgatcgtcccggtgccgcatgggcgatcaccgttcagcccatcaacgaaggcatgattgccgctggacacaagcgagggggaaacccgttaggcctctcagtcgaggatggcgatcaactccttctacttggctgcgtcttctggaacgatcctcaagatagtgccgtcatgaaggccaaaacccaagagtacatcaaagcagcgacggagttggctcgcgaacgtggactgctgaacaagtacatctacttgaactatgcattggatacgcaaaacgtcctggagagctacggcgcagggaacctgaagaagatgagggaaatcaagagtaaatacgaccccgacaaccttctggaagtatggaaggggggctggaaattgtaa

SEQ ID NO: 477 - DNA, 1518 bp, Pleurotus ostreatus
atgcgatcctacgccacctcgttgcttctctttggtcttcttgccccttctcgcgcagcgactgtggcacatgacttacgggaggaaatagcggctagagactgctgtcagacgttgcagagccagttaggcccgacagcggttctgttccccggttcagcgggcttccaacagctcgtaaactcgtactacagtgcgcaagagtcagagatcatctcccaatgtcgcgtcagtgcgcatagtgctcaggatgtttccgacgccatcaagattatcaccaagggcggctgcaagttctctgttcgctctgctgggcacatgacttgggctggcgccgccaacattcaagctcccggtgtcgccatcgatttgaagcagttgaacggagttaatgtctctgcggacaagaaggtagtcagcttgggtccaggaggatcttggggccccgtctacgatgcccttgaccccttcaacatcaccgttgtcggtggccgttcgaacaccgtcggtgtcggcggattcatccttgggggcggcttttcaaacctttcccctgcccacggcttcgcatctgacaacgtcgtcaactacgaagtcgtcctcgcagacggccgtatcgtgaacgccaataagacttccaaccccgacctcttccacggtctcaagggcgggagcaccaacctcggtatcatcactcgttacgatgtcaacgccttcccccttacccctaagtggggtggaagcaggggttacaacgtctcccagggcccggccatcttcgacgctatgatcaaattcatcaagaagctcccccaggagcctctcggcggcggatccgtcgtttggggatacagcgaggatctgaagaacgacaccatctttggttcattcgcctacctgggtgccgatgccacagagtccaaggcccagctcttctccgagatgctcgacgtcccgcccaccttcgacaccattcgcaccaacaccgaccagcaatggctcgacagcgaggttgacgttgcattcccaggcggcctgagacgcattttctcgactttgaccctcaaggtggacagggaaatcgctgagggcatctaccggaagagccacgacgccttcgctggcctcgtaggaaagccgggcgtctcatggaccgcttccttccaacccatttccatcacccatctccaggctactgagcgggctggcggcacgccacagggcttgtctcccgaagacggtgacctcatcttgctcaacctaaacaccgtctgggtcgaggaatcagatgacgcagcgatgcaagcagctgtccgcgatgtcatcaactggggaactaaagaggccaagaggcgcaacgtgctccacccttggctctacatcaactatgcgctgcccgaccagaaggtctacgagtcgtacggtaaagcaaatgtcgatgcgcttctcaagatcaagaataaattcgacccgaagaacaccttcggaaagctctggaagggagggttcaaactatag

SEQ ID NO: 478 - DNA, 873 bp, Pleurotus ostreatus
atggctcctcaagtttggttcattactggcgcatctcgcggtctcggccgctctgtgactgagacggtcttgcagaacggcgatatcgtcgtcgcaactgcccgcagcacttcagtcttctccgatctcacatccaagtaccccgaatcccagctccttgtcctctctctcgatgtctcgaacgtcgatgcaatcaaggctgctttcaaggctgcgaccgacaagttcggacgcatcgacgttgtctacaacaatgctggtgccttcactgtcggagaggccgaggctatccccgaagccgatgcccgcaagctgtttgatgtaaacttctgggctgcttccaacgtcgctctcgaggccgtcagagtcctccgtgaggtgaacaagccccaaggaggtcgcatcatcaccatcggctctgctactggcttcgcaccgttgcctggctcgaactactacgccgcatccaagttcgcaattgaagggttcatcgatgcgcttagcatggaactcgaccctgcctggaacatcaggctcacccttgttcgcccgggtggatacgacacgggctgggaaaagggcgcccaattctaccccgcccaccctgcgtacactgctccacacatgccgacagagttcggtcgccagtacatgaagacgttcaaaggttacgagggcgacccagtcaagttcgcgcagactgtgtacttcaaggttgccaaggccgaaaatcccccgtcgaaattgtcgcttggattggactgcgtcggcatggtcgagggaaagttgaaggctatttccgacgaggccgaaaaatacaagagctggtctgccgggctgaacaagtccgacccccctttgaacttcgcttga

SEQ ID NO: 479 - DNA, 2838 bp, Pleurotus ostreatus
atgccaggttcactaccccatgaccatgctgcaggagctcactctcttgacgcgttgagcccctctgatcagctgttcttcagaacacattcatttgggcccaccaaggaacccccctcgctgtgcatccatcacgcattcgagagccatgctgcatcgcaccccgaatccctcgctatcatgacttcggacgtctcgggcgcctcagagtccgttacctattcagagctcgatcgtcgggcaaatgtacttgcccagcaccttcgcgatgttcatgacgtcgtcccgggtcgccgtgtttgcttcctggtcgagcgatcggtagacatggtggttggtatactcggcatcttaaagagcggcgcggcctatattctcttggatggaaacgtcgtcgattactcgacccttgaccacgtccttcgcgacggcgatgtgacgttatactcgcgcaaattcttaccgaaggcatcgacaaccacttccgggtcgatttgtcttgaggatgtcctcaatgccaacgaaaattcgaagtgtgctaagcctgcggattattcaaagcctgacgataccgcgtatatcttctacaatagcacagaagacggccaagtagctcacaagggtgtgcccgttttacacagacacgtcattaatgttgtttgcctcgctcctggtaacattgagatggcgccgggccgtagtgtttctcaaatcatggacgtttccacaagcctggcagcctgggaaatccttggtagcctcgccaatggatgcacgctctgcttggggagccgcgactccaacgactggccgactgtggtgaggaaggccgacattgtgattgcgacaccttcaatgctcgcggcctatgaatcagcggactacccaaacgtgaaagtcatcgccgtcgtatcggaccggtgctcccaagctcttgctgacaagtgggccgccaacggtgtccatctgtacgttgggtgtgctttaactgagattgcaatcattaatacaatggcctcggaatatcacattcttggccaggctttgagcatcggaaaaccactacctaataataatgtatacgtgctacagtcaggtgccgatggactgcggccactagcactaggtgaccccggcgtcatatgggtaggtggaatgggattaacgaagagttccattaatatcgacgacgacaaatataagttggatcccttccttgccgatggatcctacatggtcaatactgggaagtcaggccgttggcatccagatggaactctagaatgccttggttctgaaacgacaacgatggtgggtgaagctgagacgaatgatggagacttggcgacgataggaagagaactcctggcaaaggattctacaaacacacttttccagactcccggccatcagcatttcaacctacctcttaccgtcggctacgggacatcggagaagaccgccgcgggcttggattcgtcagcctcctcttctactattgagaaaggtcacgaagtcttttgggcgggctacgaagacgatggtattccagacaagacgcagggaaaatttatgcgcaatttgcggcatcaggttttctctttgtaccgccggctgtttgggatcgtcttcatagtcaacatggcaatcctcatagcgaccttcgtccaaggcgaacccaatgccatgcagctaggccagatcgtgataggcaacatcttctgttctgtcctgatgcgtcaggaacatgtgatcaacgcgttctttgctgtatttactgcagtacctccatcctggccgatggctatccgtcgagtgtgcgccagagtgtacgggatcggaggcatccattctggggctgcggtatcagggacagtgtggctcattgtcttcgctgttcaagcgaccagggagcttgtatcgggtggacccacttcggtagccaccctcgtcgtgacgtactgcatcctgcttttgctcatatccatcatatgctgcgcatatccagccttccgcatcgcaaagcacaacaacttcgagcgtacacatcggttttttggttggacagtaacggcgctggtctgggcgcaagtcatcttattaaccaacgattacaaaagcgcagagacatccctgggctctgcgcttgtttcttcgcccccattttggctagtagtggtgttgacgtgctcaatcatctacccgtggctgcacctgcggaaggtcccagtacgcgcggaaatactgtcgtcgcacgccgttagactctactttgactacgtcacccctgaccctggaacattcacccgggtgtcagataacccgctatttgagtggcatggctttgctaccatcgcccaacccgggcagaagggctactcaatggtcgtctctcgcgcaggtgactggacgtccaagcagattggagacccaccaaaggagctctgggtgcggggcatccctacttgcggagtaatgagtatcgtccccatctttagacgagtggtcctcgttgcaaccggcagcggtattggccccatcactccgtggatccttcaaagtcggcacccagtgaagctgctctggacggctcctgacgttaggaagaccttcggagacaaactcgtggactcgctcttggacgcttgcccggatacggtcatctatgacactcgtaaacacggaaaaccagacatggtcaagctgacataccgccttgttcgcgagtttgatgccgaggctgttatcatcatctccaaccagaagcttactgtgaaggtcgtatacggaatgatgagtagagggatacctgcctttggggccatttgggattcatga

SEQ ID NO: 480 - DNA, 3156 bp, Pleurotus ostreatus
atgccaggatctctatctaacggccgagcggtatctggaagccttctttccactctaaccatttcggaccagctcttcttcagcaagcattcgtttgggccgatacagcagtctccgttctcctgcatacatcacgccttcgagtctcatgtcgaatctcatccccaatctctcgccgttgtggacccgttcgcgcccagcgatctgaagtcaattacctactcagagcttgatcgacaagccaattttcttgctcgacatctccgcaatatccatggcgtcgtgcccggaaaacgtgtttgcctcctcatcgagaggtcgatcttcatgattataggcatagttgcgattctcaagagcggcgctagctatattcctttggacggaaacatcgttgccgattcaaccctcagccacattattcaagactcggaggcaaactgtgtgctttcactgcgcaaatttgcatcccgggtcatttcagcgaacgcgacatccatctgcttagaggatgttctcgctaccattacggatgacgagtgcggcaaaccagttgatttatctaatcctgacgacagcgcctacattgtctataccagcggcactacaggcgttcccaaaggcgtagatgtgatgcaccgaaacgtcacaaacctcgtgtgtcttgctcctggtaacatcgagatgcgcgcaggtcgcggggtctcccagctcatgaatgtagcgtttgacatggcggcttgggaaattcttggcagcctcgctaacgggtgcacgttgttcttgcggggcaaatcctcgaaggactggcgcgcggtgatgaagatggtggacgtggtgattgccacaccttccatgctctttccacatgatcctgttgattatccgaacatcaaagtcgttgccgttgctggggaagtatgccctcagaatcttgcggacaagtgggctagcaatggcacccatttctataacagctgcggacctacggagatcacaatcgtcaatactatggtgcctcatcatcacgtatcgggagagtcgctgagcatcggaaagcctactccaaacaacaacgtatacgtactacatcgtgatgcagaagatctcgctcccgttgctattggacagcctgggatcatgtgggctggtggtgcaggcatcacgaggggctacctcaacttacccgacaaaacggaggagaggtacaaactagatcctttcgtcaacgatgggtccttgatgtttaatactggtgaccttggacgctggcgtccagatggcacgttggaacatctcggccgcatagatgatcaggttaagatcaagggattccgtgtagagcttgatggtgtcggtgctgcaatggagacctgctccggggtgaaggctgccgtcgccctccttattgatgatgttctttgggggttcttcacaccctctacagtcgaaccgaaggacgtacaggcggcagtggcgaagattcaaccatattacgccgtcccaagtcgattcattcatatggaagaattcccgaacacgatcaatggaaaagtggacaagcgagccctccgccggaaggttgaggaagaaatcgaggtagcgacgcatagcgacgccccgaagagcgttgctacgacgggagcttctgaaagttcgccaacaatcgacagagaacttctcagcaaggactcttcctccacgctttcgccacctcctatctatgaagaacgcgagatttcggagaaagagaagaaggatgctcctgggctggaagtgtctgtctctgccctgtcatcctcgagcatcgagaaaggctacgaagtctcctgggctggctaccaagacgatgacgtccccaacaaaactcaagggaaattcgttcggaacatacgacaccaaatattttcattgtatcgtcgactttttggtgtggtctttgtgacgaacatagcagttctcatcgctaccttcgctcagggggaaccgaactctctgcaattggggcagatcgtcatagcaaacctcttctgcgcaatccttatgcggcaagactatgttatcaatgccttcttcaccctcttttgttctgttcctccatcctggccaatggcgattcgtcgagtgtgcgccagggtgtatagcattggcggtttgcattctggttgcgcgatctcagggactatgtggcttgtggcgtttaccgttcaagcaacgagggagctggttcagggggggccaatttcaatccccaccgtcacgataacttattctattctcctcctacttctcctcattatattttttgcatacccagctttgcgtacgtcgaagcacgacaacttcgagcgcacgcatcgcttctttggatggtcatgtacggccctggtgtgggtccaggttgtcctcctaaccaatgactacaaagaacctgggcttgcgctcggttcggctctcgtcaaatcagcaccattttggctggtcgttatcatgacgtgctccatcattcttccatggcttcgcttgcggaaggtccccgtgcggacagaggttctctctacacatgccatacggctctacttcgactacggtgagacgcttacgcccgtctctggatcattcacccgtatctcggaaagccccctgttcgaatggcatggcttcgccactatccccgagccaggaaagaagggctattccctcgttgtctctcgtgccggcgattggacgtccaaacaaatcgcagatccgccgaaagaattgtgggttcgcggaatacctacgtgtggtgttttgcgtattgttcccatcttccggcgcattgtccttgtggcgactggcagcggcatcggtccttgcacgccgtgtattctcgagcagcgtttgcccatcaagctactttggacctctccagatgtccgcaagacgttcggcgataaactcgtcgactcgattctcagtgcgtcgcccgatgcagtgatatacgatactcgcaagcatggtaaaccagatatggtgaagctgacgtaccgccttgttcgggaattcgacgcggaggcggtctgtatcatctcaaaccagaaactcacaaagaaggtcgtgtacgggatgatgagtcgaggtataccagccttcggggcgatctgggattcctga

SEQ ID NO: 481 - DNA, 846 bp, Schizophyllum commune
atgttcagccttctccgacgacacctttacaccctcttcctcttcacgtacagcgacatgaagaccatcttgcttccaataactgtctttgcctcggtagcagcacctgcgcagtcgccacaaggcctcctactcggagtcttctggacatggttgcaccagctccacgccaacctctcaaaccagtacaaggcgctggaggaagacaagatgaacaagccctggagacccttgcccgcgcaccgcgtcactccccggcaggccgagctcctgcgctggaccctgatcccactgacgatcggcttctccactatcggcggcccacacgccatcgccgccagtatctggctcgcaacagccttggtcatctacgagcagccctccgtcagcggccactggctcggcaagaacatcctcaactgcgccggctacatcggtttcgaatacggcgcaacagcaatgctgggcgagggcaggcctctgagcgcgtcggcggtgctcttgctgctatgcagcggcctcgtcatcctcaccaccatccacgcgcaggacttcgccgacatcgccggcgactccgccctcggccgcgtcaccttccccatccgcgcccccgccctctcccgcgcgttcatctacctcggcatcccgctcctctccctcgcgctctccgtcgcctgggatatgttctgggcggcccgcgtactgttcctcgcgctcggctccgcagtcgcgtggcggttctacgccttccggacgatctcgcaggacgcgcggtcgtatgtgttgtacaatgtatggctattcagtgtacaccttttgcctgccacgcagcggcactggatgtga

SEQ ID NO: 482 - DNA, 1482 bp, Schizophyllum commune
atgtcgtatgctcttttggcagcaggcgcggcttgcatcttgctcgtcgggaatggcctctacaccctgctgtggcatcccctcgcctcataccctggcccacgacttgcggcgttgacgaagtggtaccgcgcgtacttcgacctcgtccacgatggcggttggcttgagcacctggaggagcttcatcgtcagtatggccctgtcgtacgcgtcgctgcttctgaactacacttcgcggagcccgcagcataccatgacatccacaacttcacaaaccgttttgcaaaggaccccgagttgtatcgtgccttcgacctgccacaggcgtccttcgggcaggtggatcctgtcgcggcgaagacccgccgcgacaccttgggaccactcttctcacgtcaaggtattcgcaagttcgagttcgtcattcaggataaggtcgacctcctcgtcaaccgcctcatcgaggagggctccacccgccagcccgtcaaccttttcctcgccttccgctccttcagcttcgacaccatcatgtcctactgcttcgccacctcctaccactccctcgagcacgaacgcttcgcccaccccatgatccccatcatctttaaggtcaacgtcctcacctggaccctgcgttacttccccttcctcatgagccttgtgcgctacggtccgcgcttcatcacctcccggctctcgcccgtagccgttggcttccagggcctgttcgaccactttgacaagcgggtggatgaggtgttgagcgagccggagagcctaggggccgccgggcatgatacggtattccatcatctgatcaatgggaagagagagagaccgagcaaggaggtgctgatcgaggaggcaatcacactgtttggggcggggagcgagacgacggcggcggcggtgacaacggcgattttccatgttctgaacgacaagcgcatccgcgagagggtgatggaggagctaagggaggcatggccagatccgacgatgcggttgtcggcgcaggagatcgagaagctgccgtatttgacagctgtcatcaaggaaacgttgaggttcgcgccaggtgtcgtcactcctgcccctcgcatcgtgcatcaggactccgtcatcgcgggccacccaattcctgctggaacgaccgtggccataggtgccacattcgtgcaccttaacccggaaatctacgaggacccaaagaggttcaagcccgagcgatggctgaaggagggcgcgcaggcactcgagagtgcatactttatccccttttcgaagggcccgaggatgtgtctggggcattaccttgcgtggtgcgagatgtacctcgtccttgcgaacgtcctacgcaagacggatatcactgtgttcgagaccgatgagacggactttgagttccgtcaatactggatgcccatcttccgaggacgacagctgaaggggttcgtcgagccgagaattgactaa

SEQ ID NO: 483 - DNA, 792 bp, Schizophyllum commune
atggcctccatcctcaagtcgaagtgcgtcctcgtcaccggcgcgaccgcgggcatcgggcgcgcgctcgctcgcgccatccgtgacctcccctcgaagccgactgtcatcgcgatgggccgccggcaggagcggctcgatgagcttgcgaaagagggcttcaagacggccaagttcgacatgaacacgacgcccgacaagatcagggcgttcgtggatgatatcacggcgcagtacccggagctggacgcggtcatcctgaacgcgggcgtgcagtatatcttcgacttcaccaagcccgagagcgtggatttcaacaagatcagcaccgagttcaacgtcaactacctcgccgtcgtgagcatgatgacggccttcctcccgcacctaatcaagatcgggaaagagcgccccaccctcctcgtcccggtgacctctggcctcatgacgatccccctaccgagcacggcgaactactctgcgacgaaggcggccctccacagcatctccttctccatccgcattcaaatggagaacgccaagacaaacgtgcacgtcctcgagattatccctcccctcgtcgagtccgagttgcacgacaaccaaggcaccacggaggctctgtccagattctggatgccccttgccgactttatcaacgtcgtcctcgacggcctcaaggagggcaagatcgccatcaccgccggcgcggccacctcagcgtacctccagttcgagaagggcaaggagagctaccgcaatgggctcatggggctgccagttacgcagtaa

SEQ ID NO: 484 - protein, 48 aa, Heterobasidion annosum
LAYAGFMVIGAVLMTSVLFMKTVKADDQSWKINCLWTMSLYSLPLFTL

SEQ ID NO: 485 - protein, 47 aa, Heterobasidion annosum
IMNVPVTALGLYVAWRCISYRCNTEDRKTWQLWCGWTALLSLMPLQI

SEQ ID NO: 486 - protein, 56 aa, Heterobasidion annosum
TVALAFNVLAIAVGARPVSLKSIKADQRSFYLYNVWLSVAHALPAYFHFIAQAPVF

SEQ ID NO: 487 - protein, 51 aa, Heterobasidion annosum
AARVLFLALGSAVAWRPYAFRTISQDARSYVLYNVWLPSVHLLPATQRHWM

SEQ ID NO: 488 - protein, 53 aa, Heterobasidion annosum
VASCGFLIVALPVGVRPLIFTTIAADQVSFYWYNVWLSLAHVLPGYTRFYGKV

SEQ ID NO: 489 - protein, 42 aa, Heterobasidion annosum
VASCGFLIVALPVGVRFLIFTTIAADQVSFYWYNVSYMSRVL

What is claimed is:

1. A method for producing a small molecule to screen for inhibition of a first target protein, the method comprising:

identifying a fungal protein based on its similarity to a first target protein, wherein the fungal protein has at least 60% sequence identity to the first target protein;

identifying a fungal gene cluster that is within 20,000 bases of a genomic region that encodes the fungal protein;

expressing the fungal gene cluster or a plurality of genes from the fungal gene cluster in a host cell to produce a compound;

isolating the compound produced by the fungal gene cluster or the plurality of genes from the fungal gene cluster; and screening the isolated compound for inhibition of an activity of the first target protein;

wherein the first target protein is a mammalian protein.

2. The method of claim 1, wherein the gene cluster includes a coding sequence for a protein that is an extracellular protein, a membrane tethered protein, a protein involved in a transport or secretion pathway, a protein homologous to a protein involved in a transport or secretion pathway, a protein with a peptide targeting signal, a protein with a terminal sequence with homology to a targeting signal, an enzyme that degrades small molecules, or a protein with homology to an enzyme that degrades small molecules.

3. The method of claim 1, wherein the host cell is a yeast cell.

4. The method of claim 1, wherein each expressed gene of the plurality of genes from the gene cluster is expressed under the control of a different promoter.

5. The method of claim 1, wherein the protein that has at least 60% sequence identity to the first target protein has greater than 80% sequence identity to the first target protein.

6. The method of claim 1, wherein the protein that has at least 60% sequence identity to the previously identified first target protein has greater than 90% sequence identity to the first target protein.

7. The method of claim 1, wherein the first target protein is a human protein.

8. The method of claim 7, wherein the fungal gene cluster is selected from the group consisting of (1) a cluster that comprises one or more polyketide synthases and (2) a cluster that comprises one or more non-ribosomal peptide synthetases, (3) a cluster that comprises one or more terpene synthases, (4) a cluster that comprises one or more UbiA-type terpene cyclases, and (5) a cluster that comprises one or more dimethylallyl transferases.

9. The method of claim 1, wherein the host cell is a non-yeast fungus.

* * * * *